United States Patent
Zhang et al.

(10) Patent No.: US 11,633,732 B2
(45) Date of Patent: Apr. 25, 2023

(54) CRISPR EFFECTOR SYSTEM BASED DIAGNOSTICS

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

(72) Inventors: Feng Zhang, Cambridge, MA (US); Jonathan Gootenberg, Cambridge, MA (US); Omar Abudayyeh, Cambridge, MA (US)

(73) Assignees: The Broad Institute, Inc., Cambridge, MA (US); Massachusetts Institute of Technology, Cambridge, MA (US); President and Fellows of Harvard College, Cambridge, MA (US)

( * ) Notice: Subject to any disclaimer, the term of this patent is extended or adjusted under 35 U.S.C. 154(b) by 337 days.

(21) Appl. No.: 16/753,896

(22) PCT Filed: Oct. 4, 2018

(86) PCT No.: PCT/US2018/054472
§ 371 (c)(1),
(2) Date: Apr. 6, 2020

(87) PCT Pub. No.: WO2019/071051
PCT Pub. Date: Apr. 11, 2019

(65) Prior Publication Data
US 2020/0254443 A1    Aug. 13, 2020

Related U.S. Application Data

(60) Provisional application No. 62/630,787, filed on Feb. 14, 2018, provisional application No. 62/623,529, (Continued)

(51) Int. Cl.
*C12Q 1/68* (2018.01)
*B01L 3/00* (2006.01)
(Continued)

(52) U.S. Cl.
CPC .......... *B01L 3/5023* (2013.01); *C12Q 1/6816* (2013.01); *C12Q 1/701* (2013.01);
(Continued)

(58) Field of Classification Search
CPC ....................................................... C12Q 1/68
(Continued)

(56) References Cited

U.S. PATENT DOCUMENTS 9,399,793 B2    7/2016 Hillebrand et al.
2013/0224729 A1    8/2013 Church et al.
(Continued)

FOREIGN PATENT DOCUMENTS

JP    2016535282 A    11/2016
WO    2014093622 A1    6/2014
(Continued)

OTHER PUBLICATIONS

East-Seletsky et al., Two distinct RNase activities of CRISPR-C2c2 enable guide-RNA processing and RNA detection, Nature. Oct. 13, 2016;538(7624):270-273. doi: 10.1038/nature19802. Epub Sep. 26, 2016.*
(Continued)

*Primary Examiner* — Aaron A Priest
(74) *Attorney, Agent, or Firm* — F. Brent Nix, Esq.; Johnson, Marcou, Isaacs & Nix, LLC

(57) ABSTRACT

Provided herein is a lateral flow diagnostic device and methods of using thereof. The device comprises a substrate and a first end, wherein the first end comprises a sample loading portion. The first end may further comprise a first region loaded with a detectable ligand, a CRISPR effector system, a detection construct, a first test band comprising a biotin ligand, and a second test band comprising a capture molecule for the detectable ligand. The detection construct may comprise an RNA oligonucleotide, having a first mol-
(Continued)

ecule such as FITC on a first end and a second molecule such as FAM on a second end. Contacting the sample loading portion with a sample causes the sample to flow from the sample loading portion of the substrate towards the first and second capture regions, thereby generating a detectable signal, which may be indicative of a disease state.

35 Claims, 116 Drawing Sheets

Specification includes a Sequence Listing.

Related U.S. Application Data filed on Jan. 29, 2018, provisional application No. 62/610,144, filed on Dec. 22, 2017, provisional application No. 62/568,309, filed on Oct. 4, 2017.

(51) Int. Cl.
*C12Q 1/6816* (2018.01)
*C12Q 1/70* (2006.01)

(52) U.S. Cl.
CPC . *B01L 2300/0819* (2013.01); *B01L 2300/123* (2013.01); *B01L 2300/126* (2013.01)

(58) Field of Classification Search
USPC .......................................................... 435/6.1
See application file for complete search history.

(56) References Cited

U.S. PATENT DOCUMENTS

| | | | |
|---|---|---|---|
| 2015/0152398 A1 | 6/2015 | Doudna et al. | |
| 2017/0211142 A1 | 7/2017 | Smargon et al. | |
| 2019/0062724 A1* | 2/2019 | Hsu | C12N 15/113 |
| 2019/0177775 A1* | 6/2019 | Doudna | C12Q 1/6823 |

FOREIGN PATENT DOCUMENTS

| | | | | |
|---|---|---|---|---|
| WO | 2015/109255 A1 | 7/2015 | | |
| WO | 2016/022872 A1 | 2/2016 | | |
| WO | 2016/028843 A2 | 2/2016 | | |
| WO | WO-2016028843 A2 * | 2/2016 | ............. | C12N 15/11 |
| WO | 2016/205711 A1 | 12/2016 | | |
| WO | 2017/070605 A1 | 4/2017 | | |
| WO | 2017/106657 A1 | 6/2017 | | |
| WO | 2017/219027 A1 | 12/2017 | | |
| WO | 2017218573 A1 | 12/2017 | | |
| WO | 2018/035250 A1 | 2/2018 | | |
| WO | 2018107129 A1 | 6/2018 | | |
| WO | 2018/170340 A1 | 9/2018 | | |
| WO | 2019/005866 A1 | 1/2019 | | |
| WO | 2019/071051 A1 | 4/2019 | | |
| WO | 2019126577 A2 | 6/2019 | | |
| WO | 2018107129 A8 | 7/2019 | | |
| WO | 2020028185 A1 | 2/2020 | | |
| WO | 2020028729 A1 | 2/2020 | | |

OTHER PUBLICATIONS

Gootenberg et al, Nucleic acid detection with CRISPR-Cas13a/ C2c2, Science. Apr. 28, 2017;356(6336):438-442. doi: 10.1126/ science.aam9321. Epub Apr. 13, 2017.*
Smirnov, et al., "CRISPR/Cas9, a universal tool for genomic engineering," Vavilov Journal of Genetics and Breeding, vol. 20, No. 4 (2016), all enclosed pages cited.
Office Action from corresponding Russian application No. 2020115264 dated Feb. 24, 2022, all enclosed pages cited.
Office Action and translation from corresponding Japanese application No. 2020-519256 dated Oct. 4, 2022, all enclosed pages cited.
International Preliminary Report on Patentability issued in International Application No. PCT/US2018/054472, dated Apr. 16, 2020, 17 pages.
International Search Report and Written Opinion issued in International Application No. PCT/US2018/054472, dated Dec. 27, 2018, 20 pages.
Abudayyeh et al., "C2C2 is a Single-Component Programmable RNA-Guided RNA-Targeting CRISPR Effector", Science, vol. 353, No. 6299, Aug. 5, 2016, 23 pages.
Abudayyeh et al., "RNA Targeting with CRISPR-Cas13a", Nature, vol. 550, No. 7675, Oct. 4, 2017, 30 pages.
Barletta et al., "Lowering the Detection Limits of HIV-1 Viral Load Using Real-Time Immuno-PCR for HIV-1 p24 Antigen", American Journal of Clinical Pathology, vol. 122, 2004, 20-27.
Barzon et al., "Zika Virus: from Pathogenesis to Disease Control", FEMS Microbiol Letters, vol. 363, No. 18, 2016, 43 pages.
Bettegowda et al., "Detection of Circulating Tumor DNA in Farly- and Late-Stage Human Malignancies", Science Translational Medicine, vol. 6, No. 224, Feb. 2014, 1-25.
Chavez et al., "Comparative Analysis of Cas9 Activators Across Multiple Species", Nature Methods, vol. 13, No. 7, Jul. 2016, 563-567.
Compton, J., "Nucleic Acid Sequence-based Amplification", Nature, vol. 350, No. 6313, 1991, 91-92.
Dejnirattisai et al., "Dengue Virus Sero-cross-reactivity Drives Antibody-dependent Enhancement of Infection with Zika Virus", Nature Immunology, vol. 17, No. 9, Sep. 2016, 18 pages.
Du et al., "Reservoir Computing using Dynamic Memristors for Temporal Information Processing", Nature Communications, vol. 8, No. 2204, Dec. 19, 2017, 10 pages.
East-Seletsky et al., "Two Distinct RNase Activities of CRISPR-C2c2 Enable Guide-RNA Processing and RNA Detection", Nature, vol. 538, No. 7624, Oct. 13, 2016, 17 pages.
Emmadi et al., "Molecular Methods and Platforms for Infectious Diseases Testing a Review of FDA-Approved and Cleared Assays", The Journal of Molecular Diagnostics, vol. 13, No. 6, Nov. 2011, 583-604.
Eriksson et al., "Web-Based, Participant-Driven Studies Yield Novel Genetic Associations for Common Traits", PLOS Genetics, vol. 6, No. 6, Jun. 2010, 20 pages.
Gootenberg et al., "Multiplexed and Portable Nucleic Acid Detection Platform with Cas13, Cas12a, and Csm6", Science, vol. 360, No. 6387, Apr. 27, 2018, 14 pages.
Gootenberg et al., "Nucleic Acid Detection with CRISPR-Cas13a/ C2c2", Science, vol. 356, No. 6336, Apr. 28, 2017, 6 pages.
Gourinat et al., "Detection of Zika Virus in Urine", Emerging Infectious Diseases, vol. 21, No. 1, Jan. 2015, 34-86.
Green et al., "Toehold Switches: De-Novo-Designed Regulators of Gene Expression", Cell, vol. 159, No. 4, Nov. 6, 2014, 28 pages.
Guan et al., "Visual and Rapid Detection of Two Genetically Modified Soybean Events Using Loop-mediated sothermal Amplification Method", Food Analytical Methods, vol. 3, Issue 4, Mar. 26, 2010, 313-320.
Gupta et al., "Carbapenem-Resistant Enterobacteriaceae: Epidemiology and Prevention", Clinical Infectious Diseases, vol. 53, No. 1, Jul. 2011, 60-67.
Lanciotti et al., "Genetic and Serologic Properties of Zika Virus Associated with an Epidemic, Yap State, Micronesia, 2007", Emerging Infectious Disease, vol. 14, No. 8, Aug. 2008, 1232-1239.
Lewis et al., "Building the Class 2 CRISPR-Cas Arsenal", Molecular Cell, vol. 65, No. 3, Feb. 2, 2017, 377-379.
Maheswaran et al., "Detection of Mutations in EGFR in Circulating Lung-Cancer Cells", The New England Journal of Medicine, vol. 359, No. 4, Jul. 24, 2008, 19 pages.
Kazlauskiene et al., "A Cyclic Oligonucleotide Signaling Pathway in type III CRISPR-Cas Systems", Science, vol. 357, No. 6351, Aug. 11, 2017, 6 pages.
Li et al., "Engineering CRISPR-Cpf1 CrRNAS and MRNAs to Maximize Genome Editing Efficiency", Nature Biomedical Engineering, vol. 1, No. 5, May 2017, 21 pages.
Millipore, Merck, "Rapid Lateral Flow Test Strips", 2013, 36 pages.

(56) References Cited

OTHER PUBLICATIONS

Nagrath et al., "Isolation of Rare Circulating Tumour Cells in Cancer Patients by Microchip Technology", Nature, vol. 450, No. 7173, Dec. 20, 2007, 11 pages.
Newman et al., "An Ultrasensitive Method for Quantitating Circulating Tumor DNA with Broad Patient Coverage", Nature Medicine, vol. 20, No. 5, May 2014, 22 pages.
Pardee et al., "Paper-Based Synthetic Gene Networks", Cell, vol. 159, No. 4, Nov. 6, 2014, 28 pages.
Pardee et al., "Rapid, Low-Cost Detection of Zika Virus Using Programmable Biomolecular Components", Cell, vol. 165, May 19, 2016, 24 pages.
Piepenburg et al., "DNA Detection Using Recombination Proteins", PLOS Biology, vol. 4, Issue 7, Jun. 13, 2006, 1115-1121.
Qin et al., "YAP Induces Human Naive Pluripotency", Cell Reports, vol. 14, Mar. 15, 2016, 28 pages.
Rissin et al., "Single-Molecule Enzyme-Linked Immunosorbent Assay Detects Serum Proteins at Subfemtomolar Concentrations", Nature Biotechnology, vol. 28, No. 6, Jun. 2010, 21 pages.
Rouillon et al., "Structure of the CRISPR Interference Complex CSM Reveals Key Similarities with Cascade", Molecular Cell, vol. 52, No. 1, Oct. 10, 2013, 124-134.
Shmakov et al., "The CRISPR Spacer Space is Dominated by Sequences from Species-Specific Mobilomes", American Society for Microbiology, vol. 8, Issue 5, Sep./Oct. 2017, 18 pages.
Smargon et al., "Cas 13B is a Type VI-B CRISPR-Associated RNA-Guided RNAse Differentially Regulated by Accessory Proteins Csx27 and Csx28", Molecular Cell, vol. 65, No. 4, Feb. 16, 2017, 30 pages.
Song,"Cohabiting Family Members share Microbiota with one Another and with their Dogs", Elife, vol. 2, Apr. 16, 2013, 22 pages.
Niewoehner et al., "Structural Basis for the Endoribonuclease Activity of the Type III-A CRISPR-Associated Protein Csm6", Cold Spring Harbor Laboratory Press, vol. 22, No. 3, 2016, 318-329.
Urdea et al., "Requirements for High Impact Diagnostics in the Developing World", Nature, vol. 444, 2006, 73-79.
Wang et al., "Detection of Roundup Ready Soybean by Loop-mediated Isothermal Amplification combined with a Lateral-flow Dipstick", Food Control, vol. 29, Issue 1, Jan. 2013, 213-220.
Wang et al., "Instant, Visual, and Instrument-Free Method for On-Site Screening of GTS 40-3-2 Soybean Based on Body-Heat Triggered Recombinase Polymerase Amplification", Analytical Chemistry, vol. 89, No. 8, Mar. 27, 2017, 7 pages.
Wu et al., "Personalized Targeted Therapy for Lung Cancer", International Journal of Molecular Sciences, vol. 13, No. 9, Sep. 13, 2012, 11471-11496.
Ye et al., "Primer-BLAST: A Tool to Design Target-Specific Primers for Polymerase Chain Reaction", BMC Bioinformatics, vol. 13, No. 134, 2012, all enclosed pages cited.
Zetsche et al., "Cpf1 is a Single RNA-Guided Endonuclease of a Class 2 CRISPR-Cas System", Cell, vol. 163, No. 3, Oct. 22, 2015, 759-771.
Shmakov et al., "Discovery and Functional Characterization of Diverse Class 2 CRISPR-Cas Systems", Molecular Dell, vol. 60, No. 3, Nov. 5, 2015, 385-397.
Kumar, P., et al., "Loop-Mediated Isothermal Amplification Assay for Rapid and Sensitive Diagnosis of Tuberculosis," Journal of Infection 69 (2014), pp. 607-615.
Olmedillas Lopez, S., et al., "KRAS G12V Mutation Detection by Droplet Digital PCR in Circulating Cell-Free DNA of Colorectal Cancer Patients," International Journal of Molecular Sciences 17 (2016), all enclosed pages cited.
Office Action and translation from corresponding Saudi Arabian application No. 520411686 dated Sep. 14, 2022, all enclosed pages cited.
Rohrman, et al., "A lateral flow assay for quantitative detection of HIV-1 RNA," PLOS One, vol. 7, No. 9, Sep. 21, 2012, all enclosed pages cited.
Shen, et al., "CRISPR-Cas12a target binding unleashes indiscriminate single-stranded DNase activity," Science, vol. 360, No. 6387, Apr. 27, 2018, all enclosed pages cited.
Mlyhrvold, et al., "Field-deployable viral diagnostics using CRISPR-Cas 13," Science, vol. 360, No. 6387, Apr. 27, 2018, all enclosed pages cited.
Extended Search Report and Written Opinion of corresponding European application No. 18/864,541 0 dated Jun. 1, 2021, all enclosed pages cited.

\* cited by examiner

This is C2c2 signal on paper for a 20pM target. Note that the freeze-drying before actually boosts signal (the right plot).

A
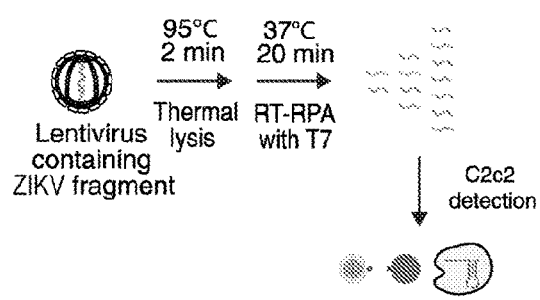
B
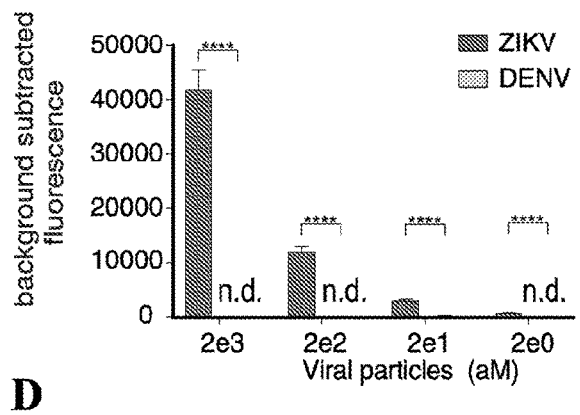
C
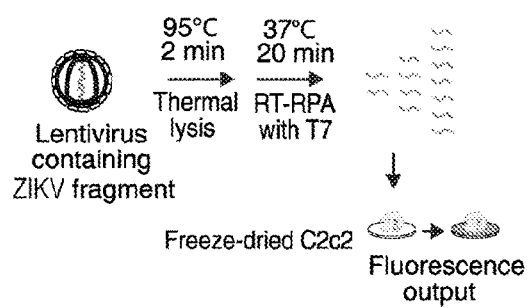
D
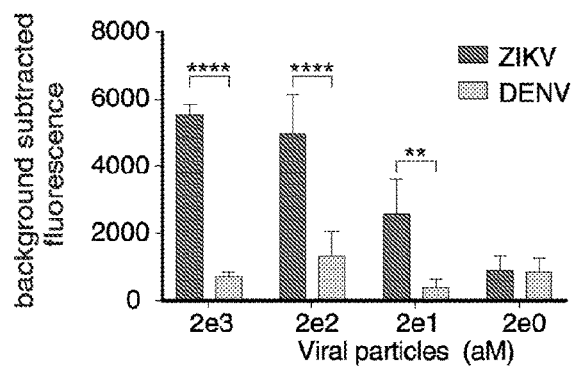
FIG. 31

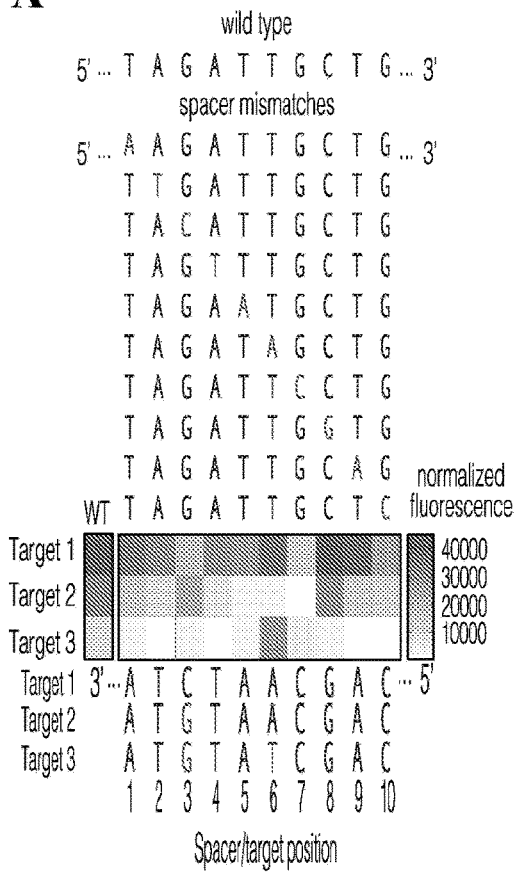
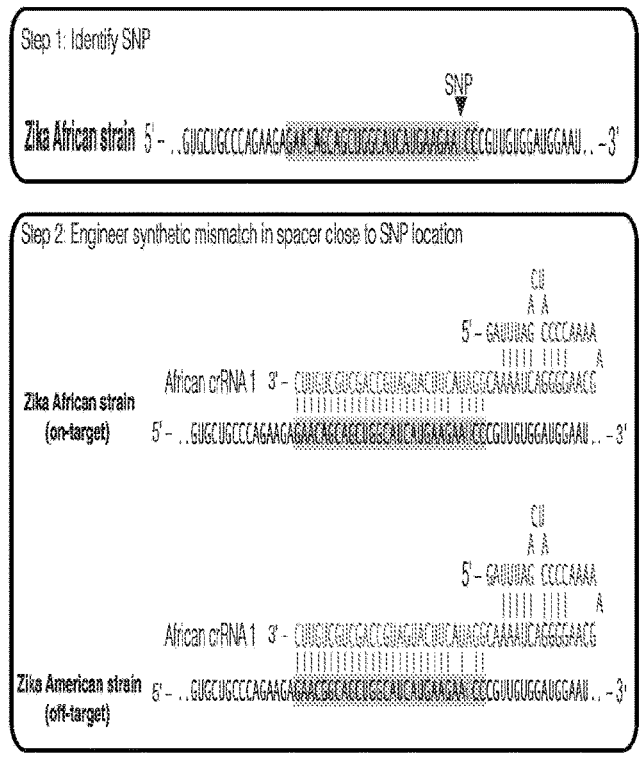
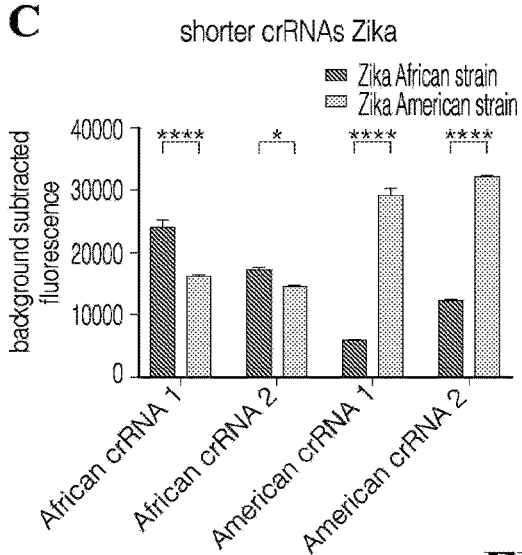
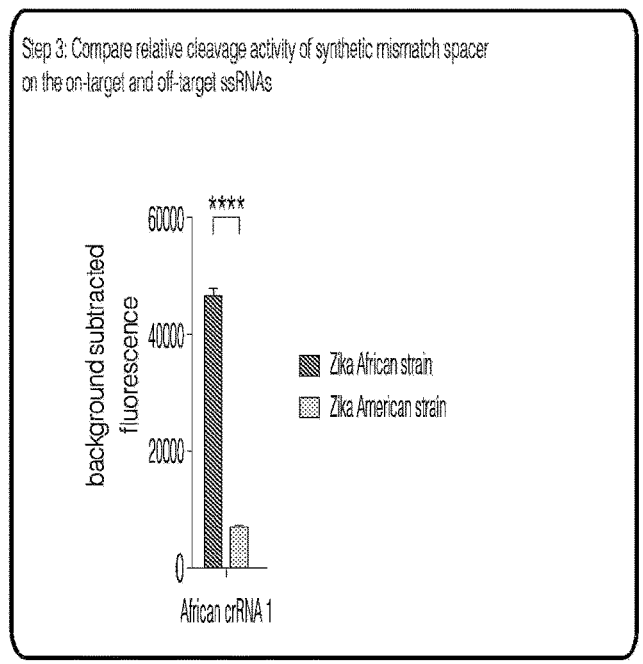
FIG. 36

A 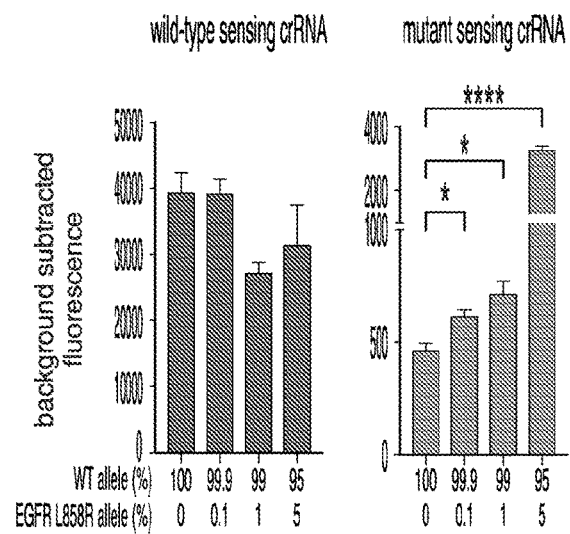 B 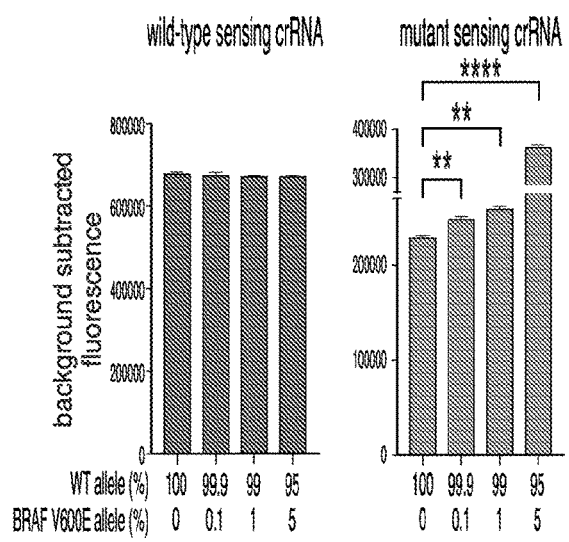
FIG. 39

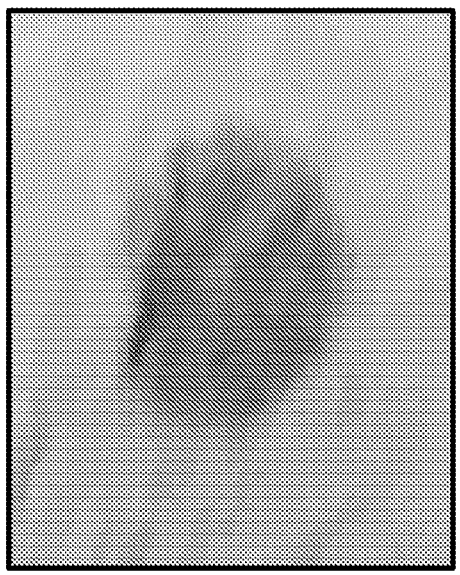 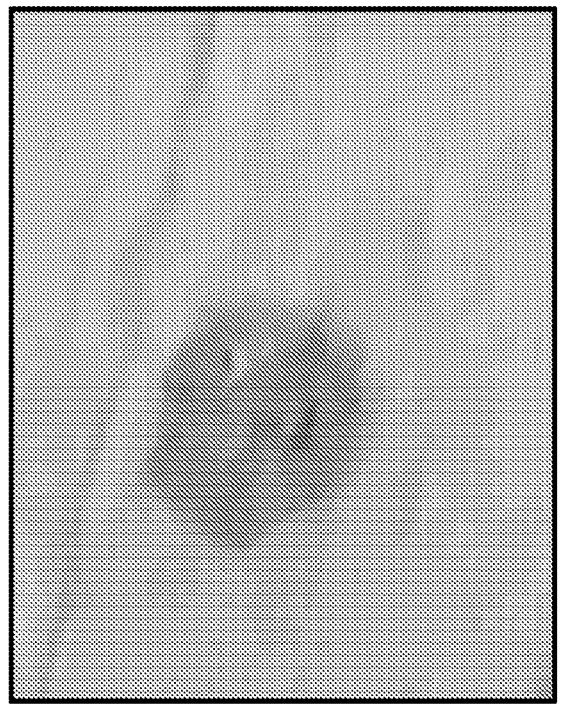
30 units RNase A  no RNase A
FIG. 47

|                                           | 586            603 | 1276            1290 |
|-------------------------------------------|--------------------|----------------------|
| c2c2_Leptotrichia shahii                  | IRKFTKIGTN ERNRILHA | SIRNYISHFYIVRNP     |
| c2c2-5 Lachnospiraceae bacterium MA2020   | LYSLKSMLYS MRNSSFHF | IFRNEIDHFHYFYDR     |
| c2c2-6 Lachnospiraceae                    | LTDLKDVIYS MRNDSFHY | ELRNYIEHFRYYSSF     |
| c2c2-7 [Clostridium] aminophilum DSM 10710 | ADDLRKAIYS LRNETFHF | DVRKYVDHFKYYATS    |
| c2c2-8 Carnobacterium gallinarum DSM 4847 | IWALRGSVQQ IRNEIFHS | KIRNQTAHLSVLQLE     |
| c2c2-9 Carnobacterium gallinarum DSM 4847 | LWAIRGAVQR VRNQIFHQ | EIRNNIAHLHVLRND     |
| c2c2-10 Paludibacter propionicigenes WB4  | LWGIRGAVQQ IRNNVNHY | DIRNHIAHFNYLTKD     |
| c2c2-11 Listeria weihenstephanensis FSL R9-0317 | IWAIRGSIQQ IRNEVYHC | NARNHIAHLNYLSLK |
| c2c2-12 Listeriaceae bacterium FSL M6-0635 | IWAIRGSIQQ IRNEVYHC | NARNHIAHLNYLSLK     |
| c2c2-13 Leptotrichia wadei F0279          | FANIDEAISS IRHGIVHF | YIRNYIAHFNYIPHA     |
| c2c2-14 Rhodobacter capsulatus SB 1003    | VFALLRYLRG CRNQTFHL | QTRKDLAHFNVLDRA     |
| c2c2-15 Rhodobacter capsulatus R121       | VFALLRYLRG CRNQTFHL | QTRKDLAHFNVLDRA     |
| c2c2-16 Rhodobacter capsulatus DE442      | VFALLRYLRG CRNQTFHL | QTRKDLAHFNVLDRA     |
| c2-3 L wadei (Lw2)                        | FANIDEAISS IRHGIVHF | YIRNYIAHFNYIPHA     |
| c2-4 Listeria seeligeri                   | SWGLRGAIAP IRNEIIHL | EKRNNISHFNYLNGQ     |
|                                           | ↑↑   ↑             | ↑↑  ↑                |

FIG. 50

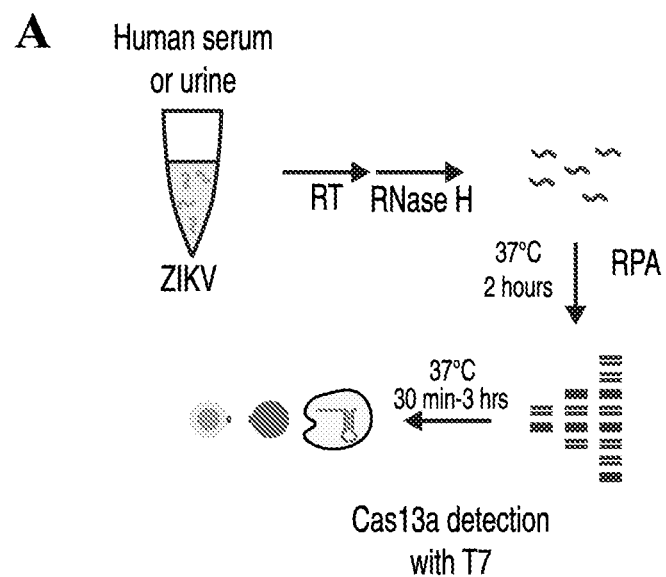
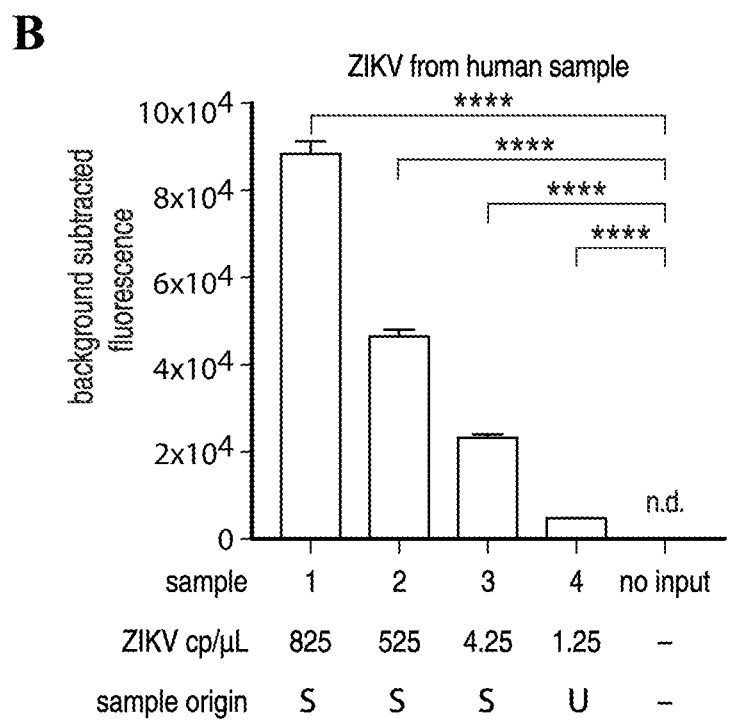
FIG. 52

A

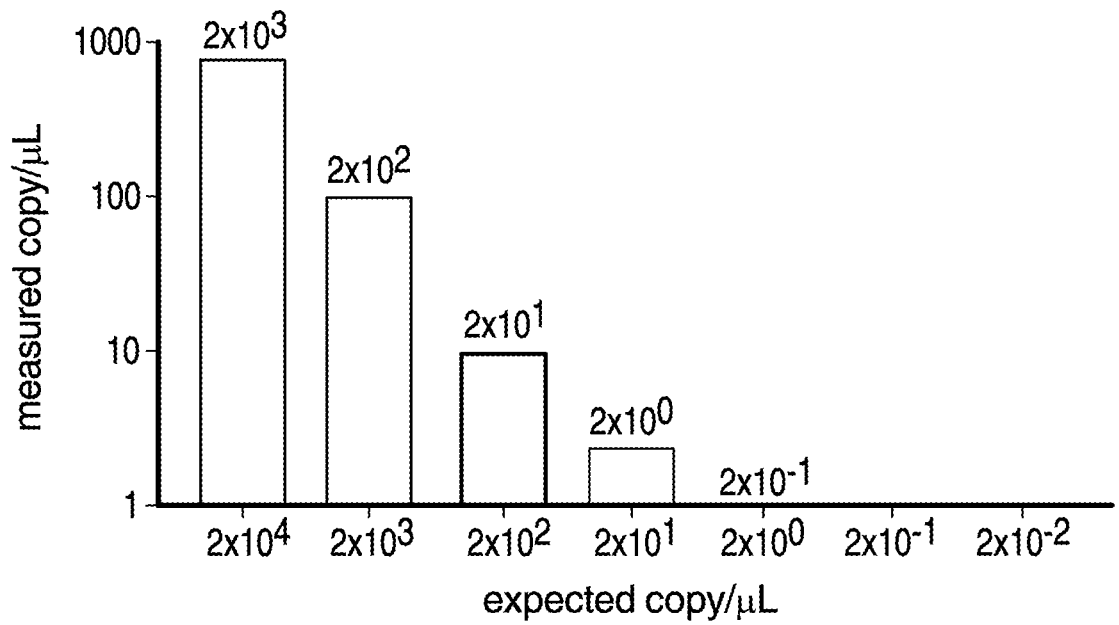
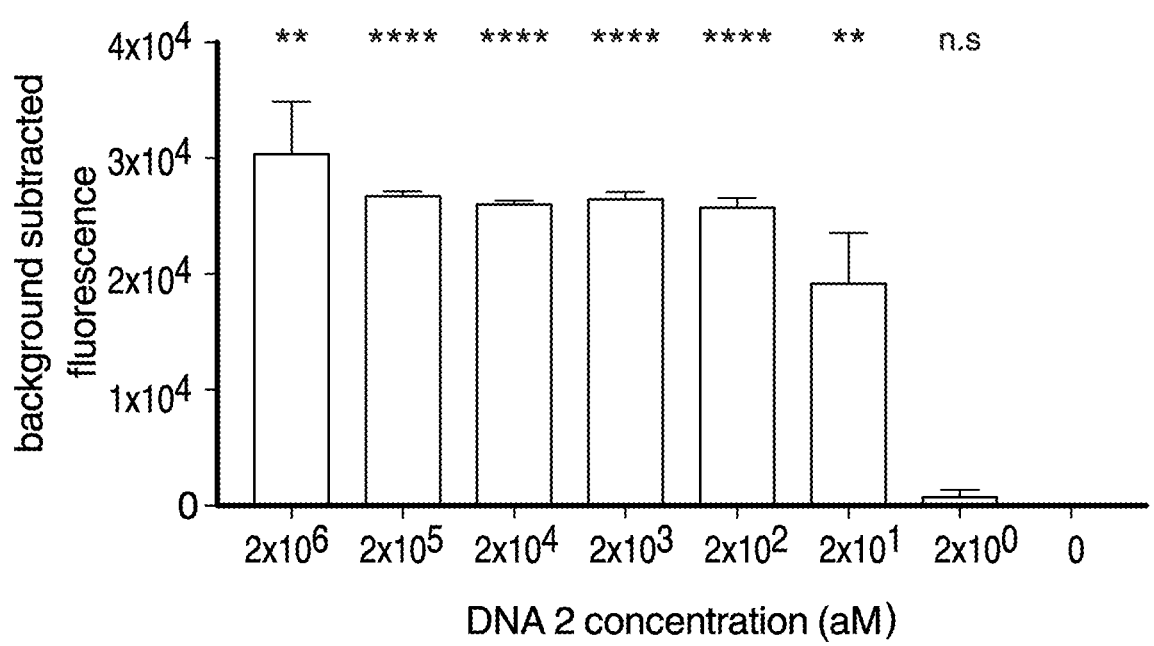
FIG. 54

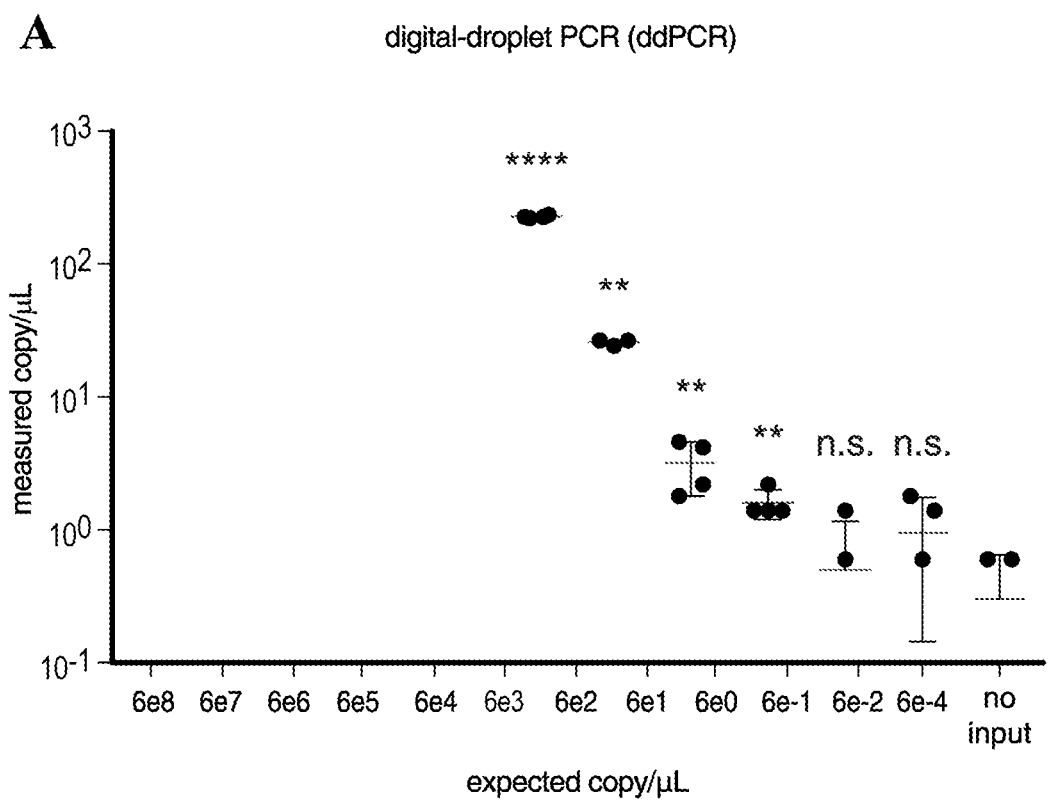
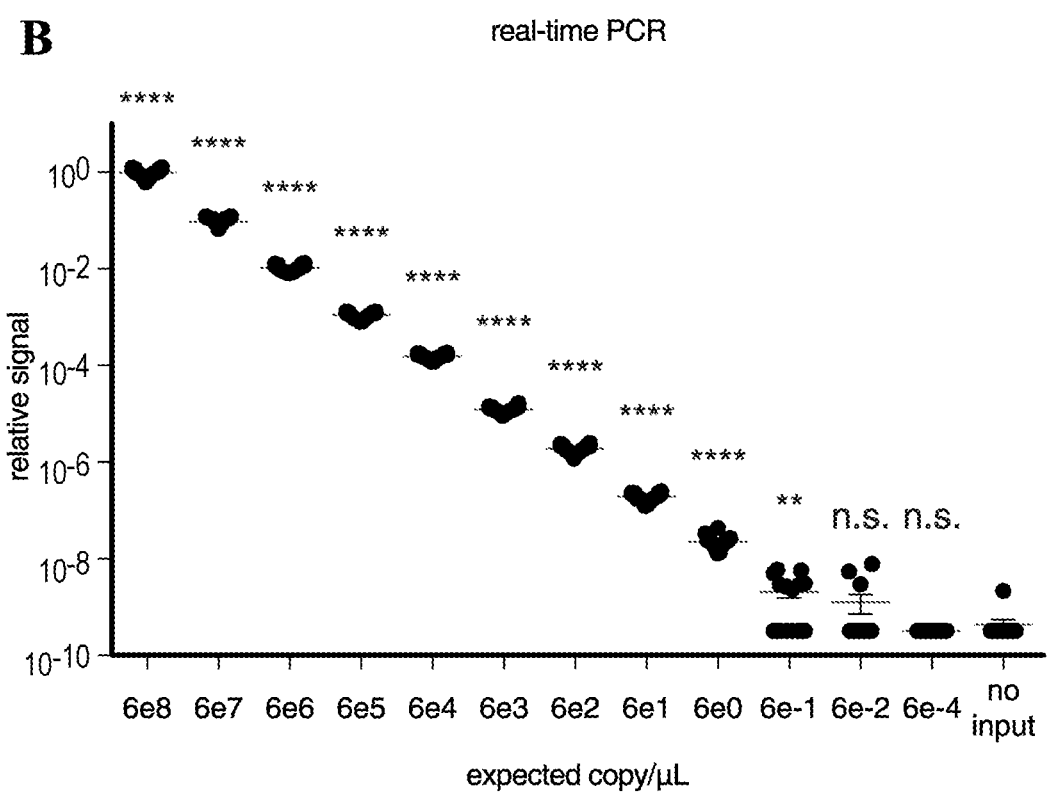
FIG. 55

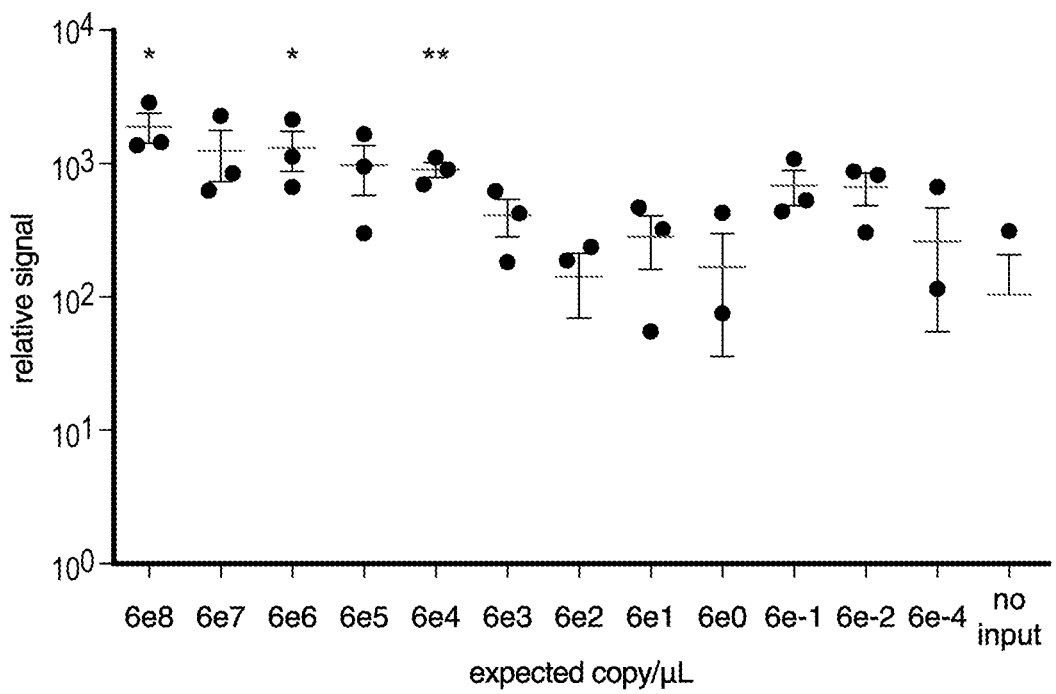
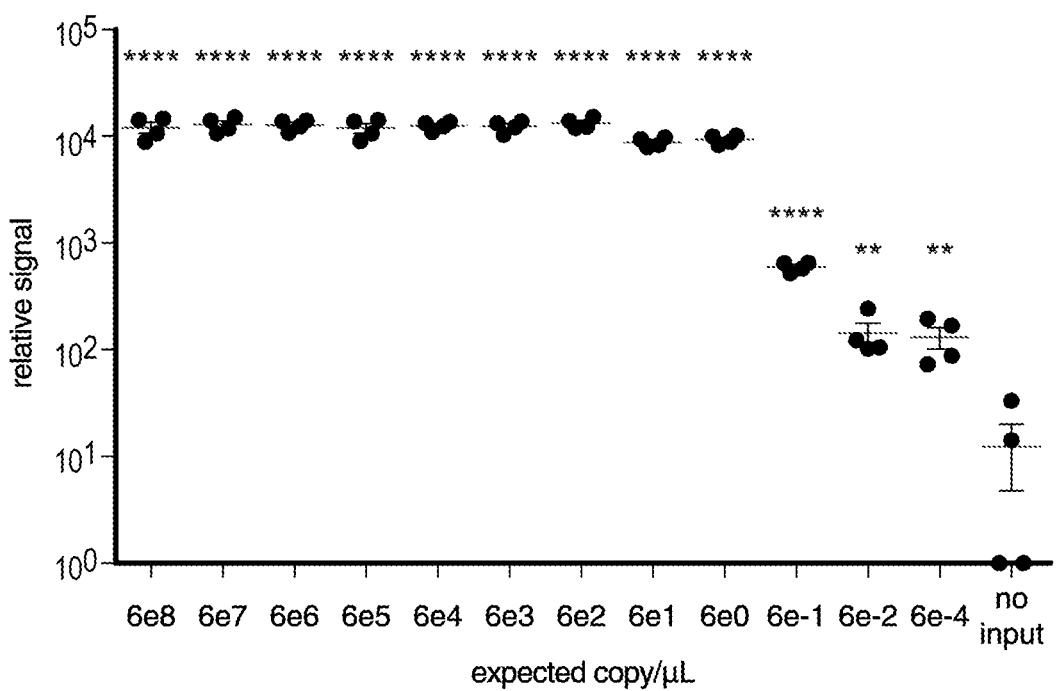
FIG. 55

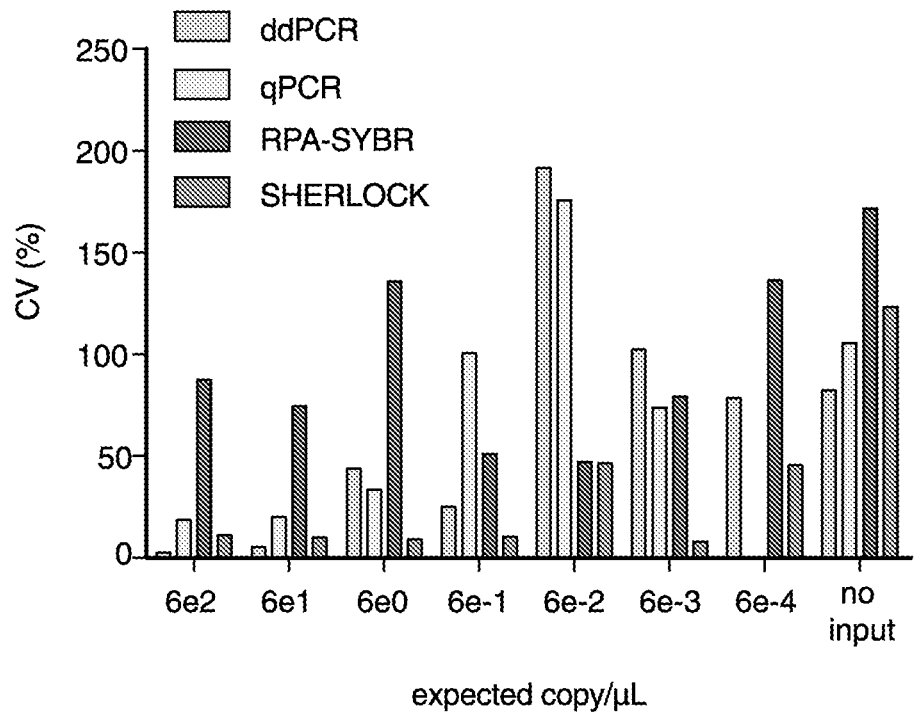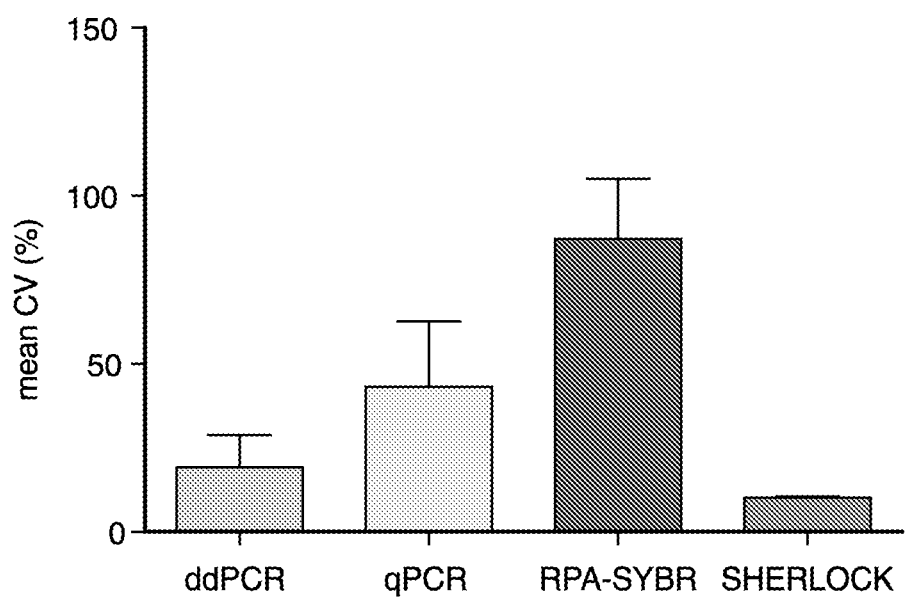
FIG. 55

A

```
           UC
         A  A
  AAAACCCC  GAUUUAG  -5'
A         ||||  |||||
  GCAAGGGGACUAAAACUAGAUUGCUGUUCUACCAAGUAAUCCAU  -3'  28nt
                    UAGAUUGCUGUUCUACCAAGUAA     -3'  23nt
                    UAGAUUGCUGUUCUACCAAG        -3'  20nt
```

3'-..AUCUAACGACAAGAUGGUUCAUUAGGUA.. - 5' ssRNA 1

3'-..AU■UAACGACAAGAUGGUUCAUUAGGUA.. - 5' ssRNA 2

| | | |
|---|---|---|
| UAGAUUGCUGUUCUACC.. | None | |
| AAGAUUGCUGUUCUACC.. | 1 | |
| UUGAUUGCUGUUCUACC.. | 2 | crRNA |
| UAGUUUGCUGUUCUACC.. | 4 | mismatch |
| UAGAAUGCUGUUCUACC.. | 5 | position |
| UAGAUAGCUGUUCUACC.. | 6 | |
| UAGAUUCCUGUUCUACC.. | 7 | |

FIG. 57

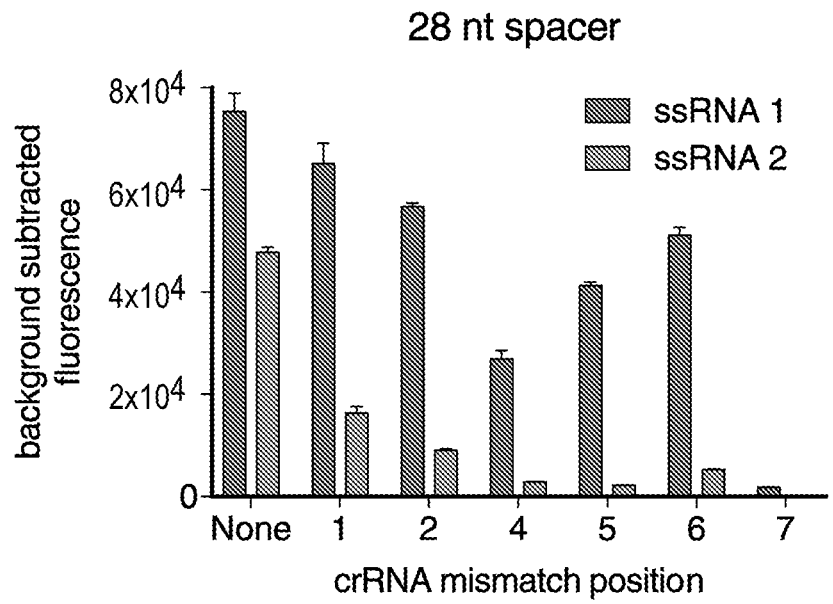
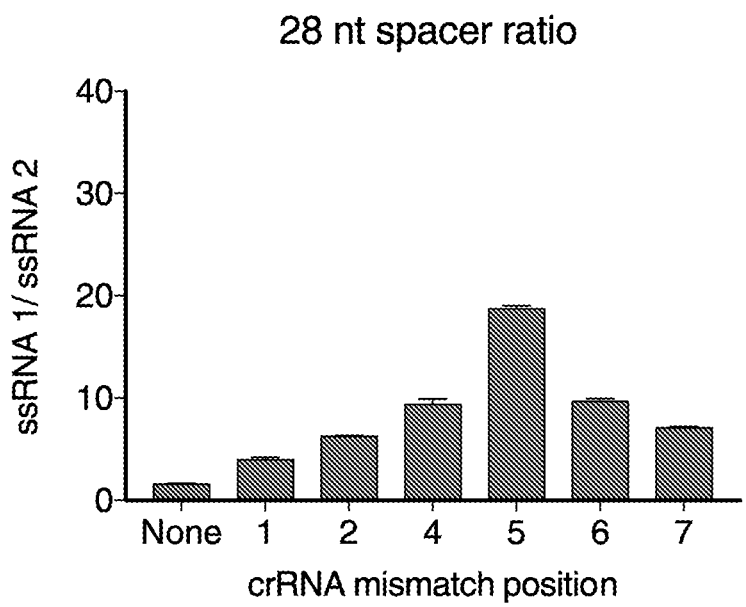
FIG. 57

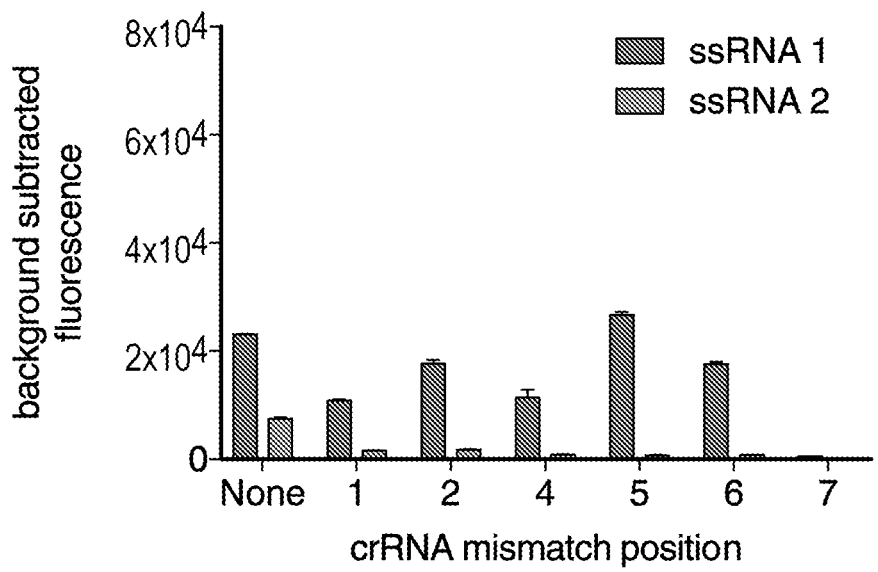
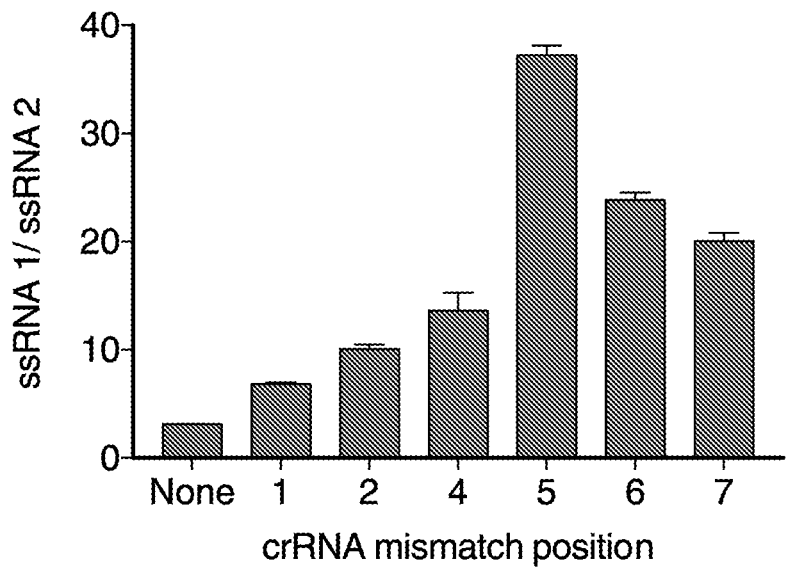
FIG. 57

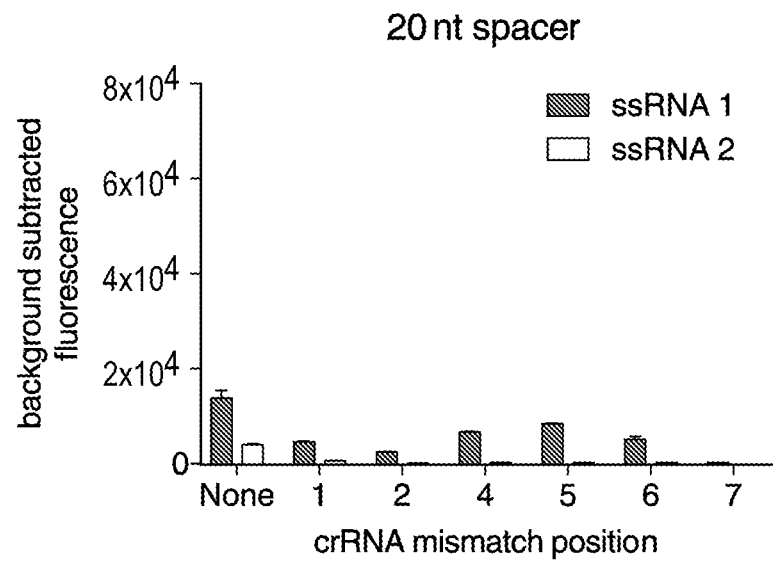
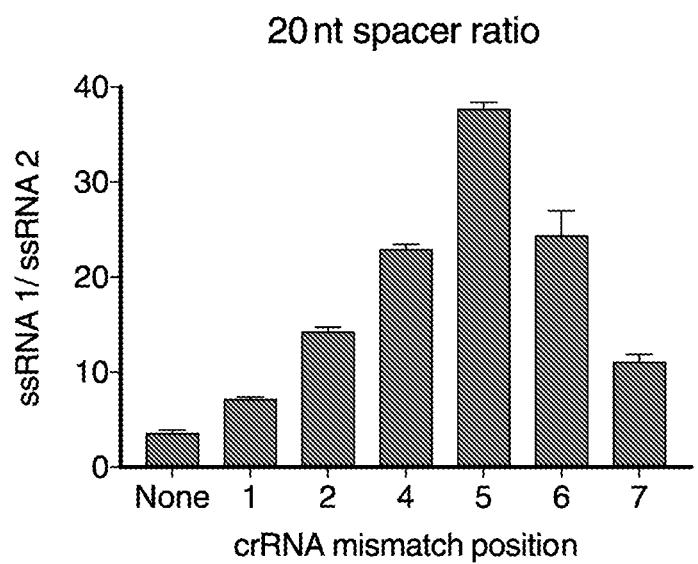
FIG. 57

A

```
3'-..CUCAUCUAACGACAAGAUGGUUCAUUAGGUA.. - 5' ssRNA 1
3'-..CUCAU▓UAACGACAAGAUGGUUCAUUAGGUA.. - 5' ssRNA 2
```

| target mismatch position 3 | | crRNA mismatch position |
|---|---|---|
| | ..AAGAUUGCUGUUCUACCAAGUAAUCCAU | 1 |
| | ..UUGAUUGCUGUUCUACCAAGUAAUCCAU | 2 |
| | ..UAGUUUGCUGUUCUACCAAGUAAUCCAU | 4 |
| | ..UAGAAUGCUGUUCUACCAAGUAAUCCAU | 5 |
| | ..UAGAUAGCUGUUCUACCAAGUAAUCCAU | 6 |
| | ..UAGAUUCCUGUUCUACCAAGUAAUCCAU | 7 |

```
3'-..CUCAUCUAACGACAAGAUGGUUCAUUAGGUA.. - 5' ssRNA 1
3'-..CUCAU▓UAACGACAAGAUGGUUCAUUAGGUA.. - 5' ssRNA 2
```

| target mismatch position 4 | | crRNA mismatch position |
|---|---|---|
| | ..CUAGAUUGCUGUUCUACCAAGUAAUCCA | 1 |
| | ..GAAGAUUGCUGUUCUACCAAGUAAUCCA | 2 |
| | ..GUUGAUUGCUGUUCUACCAAGUAAUCCA | 3 |
| | ..GUAGUUUGCUGUUCUACCAAGUAAUCCA | 5 |
| | ..GUAGAAUGCUGUUCUACCAAGUAAUCCA | 6 |
| | ..GUAGAUAGCUGUUCUACCAAGUAAUCCA | 7 |

```
3'-..CUCAUCUAACGACAAGAUGGUUCAUUAGGUA.. - 5' ssRNA 1
3'-..CUCAU▓UAACGACAAGAUGGUUCAUUAGGUA.. - 5' ssRNA 2
```

| target mismatch position 5 | | crRNA mismatch position |
|---|---|---|
| | ..ACUAGAUUGCUGUUCUACCAAGUAAUCC | 2 |
| | ..AGAAGAUUGCUGUUCUACCAAGUAAUCC | 3 |
| | ..AGUUGAUUGCUGUUCUACCAAGUAAUCC | 4 |
| | ..AGUAGUUUGCUGUUCUACCAAGUAAUCC | 6 |
| | ..AGUAGAAUGCUGUUCUACCAAGUAAUCC | 7 |
| | ..AGUAGAUAGCUGUUCUACCAAGUAAUCC | 8 |

```
3'-..CUCAUCUAACGACAAGAUGGUUCAUUAGGUA.. - 5' ssRNA 1
3'-..CUCAU▓UAACGACAAGAUGGUUCAUUAGGUA.. - 5' ssRNA 2
```

| target mismatch position 6 | | crRNA mismatch position |
|---|---|---|
| | ..G ACUAGAUUGCUGUUCUACCAAGUAAUC | 3 |
| | ..G AGAAGAUUGCUGUUCUACCAAGUAAUC | 4 |
| | ..G AGUUGAUUGCUGUUCUACCAAGUAAUC | 5 |
| | ..G AGUAGUUUGCUGUUCUACCAAGUAAUC | 7 |
| | ..G AGUAGAAUGCUGUUCUACCAAGUAAUC | 8 |
| | ..G AGUAGAUAGCUGUUCUACCAAGUAAUC | 9 |

FIG. 58

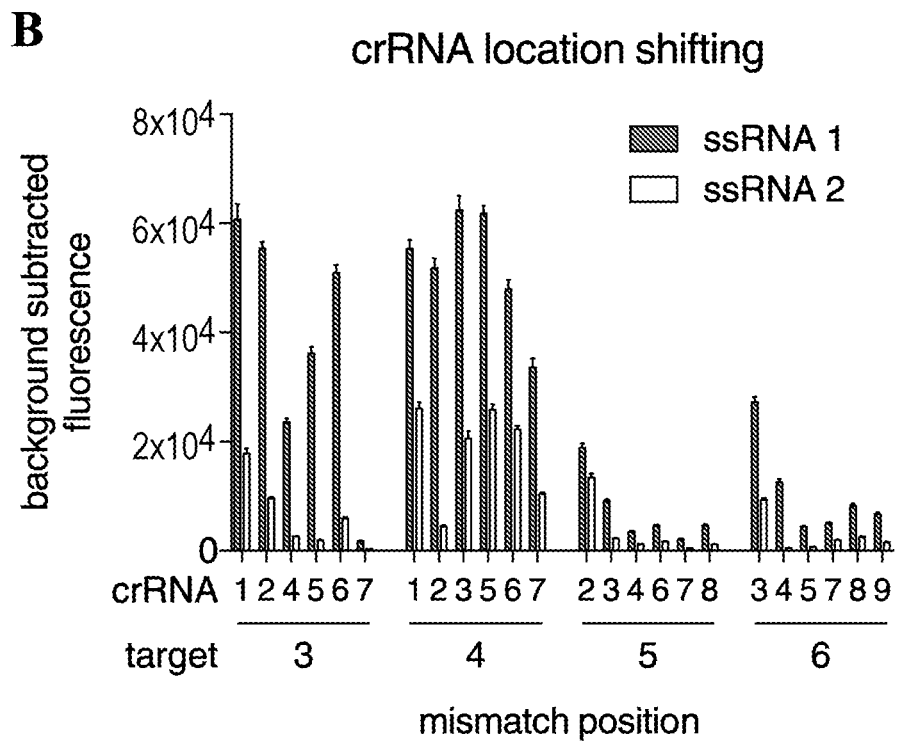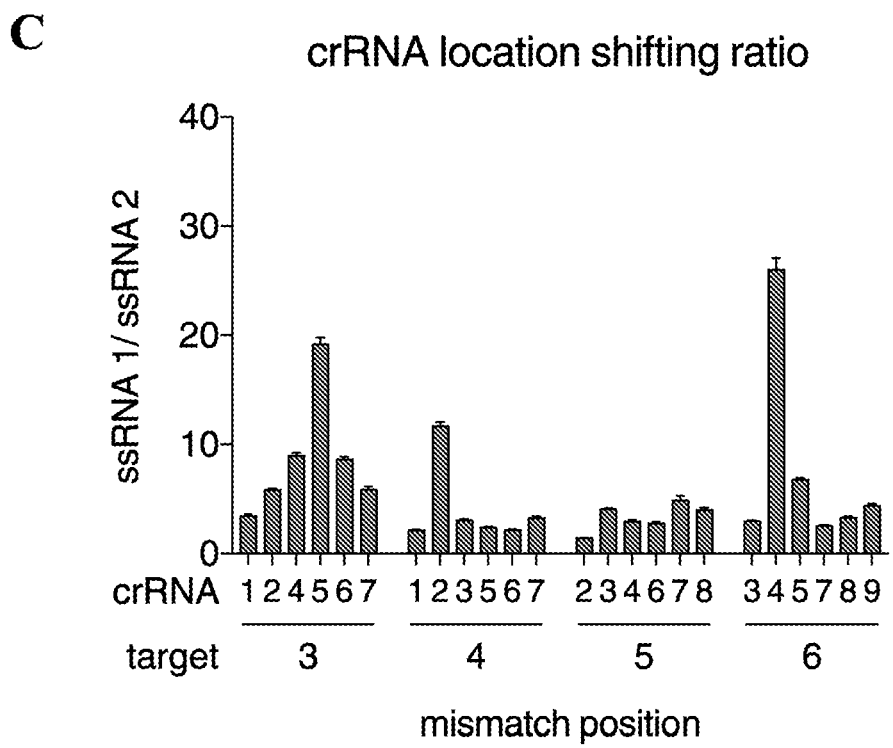
FIG. 58

A
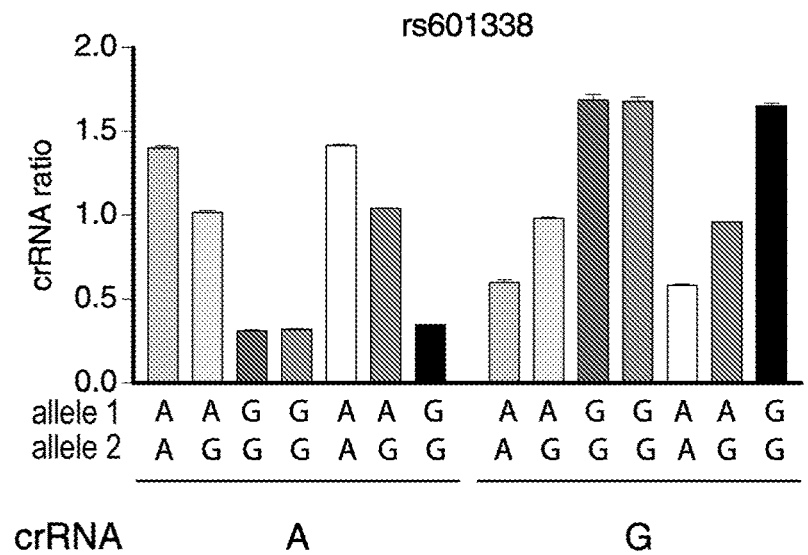
B
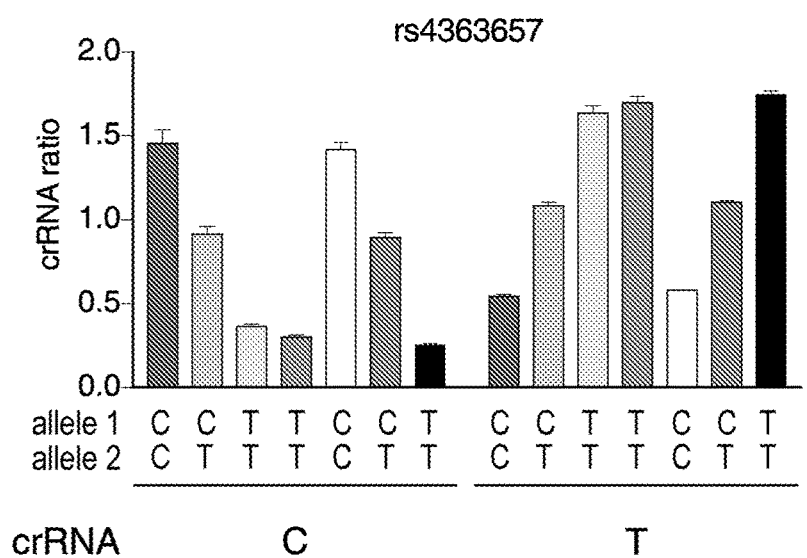
FIG. 60

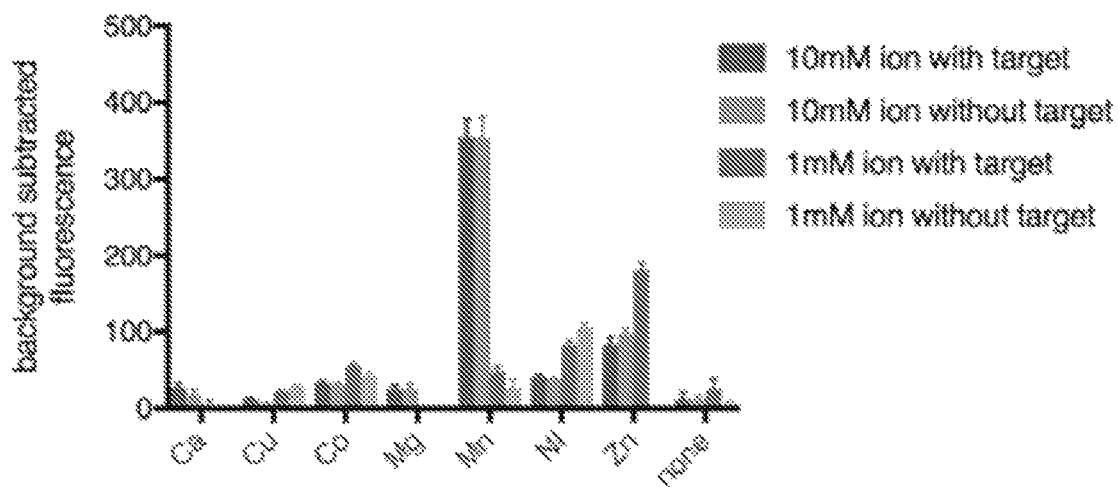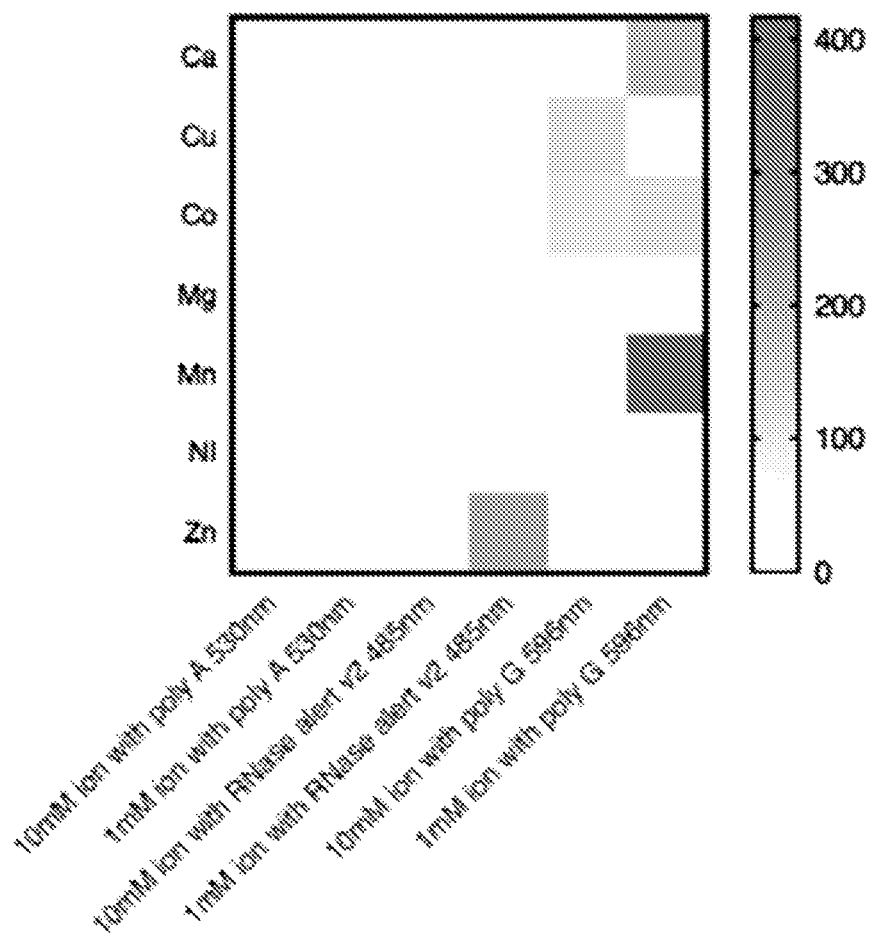
FIG. 75

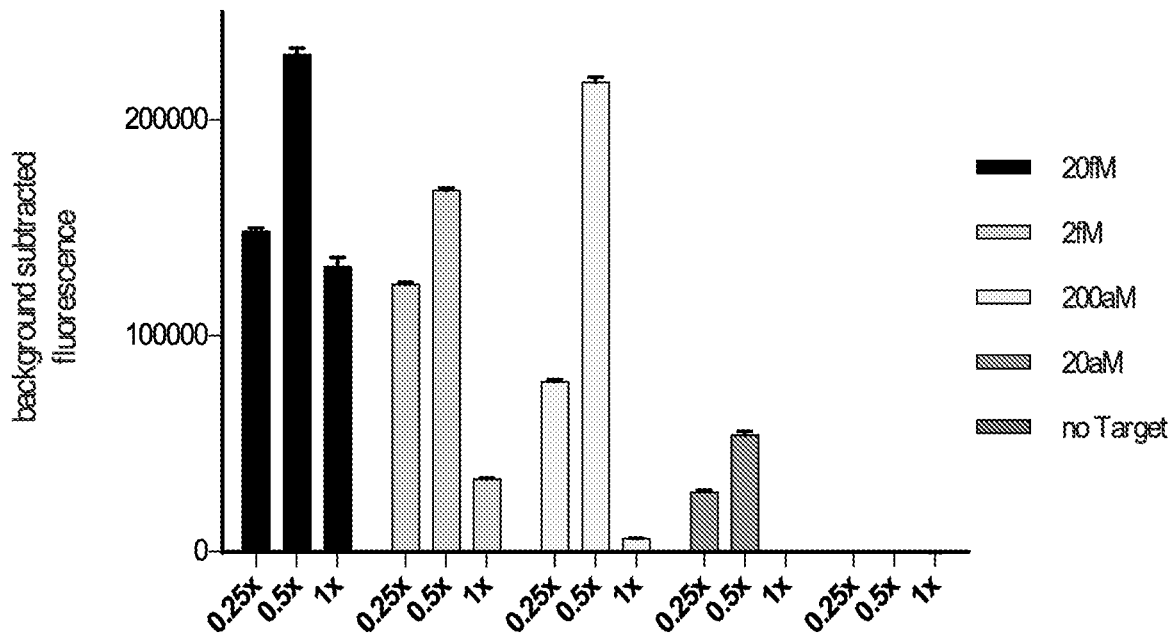
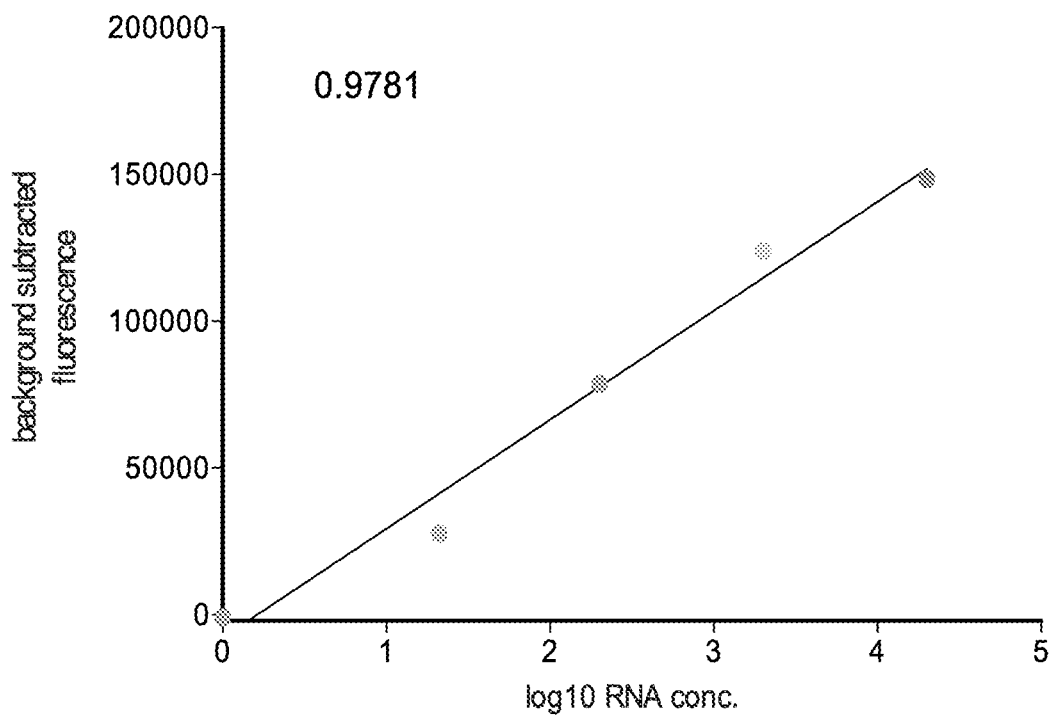
FIG. 82

CRISPR EFFECTOR SYSTEM BASED DIAGNOSTICS

CROSS REFERENCE TO RELATED APPLICATIONS

This application is a U.S. National Phase entry of International Application No. PCT/US2018/054472 filed Oct. 4, 2018, which claims priority to U.S. Provisional Application No. 62/568,309 filed Oct. 4, 2017, U.S. Provisional Application No. 62/610,144 filed Dec. 22, 2017, U.S. Provisional Application No. 62/623,529 filed Jan. 29, 2018, and U.S. Provisional Application No. 62/630,787 filed Feb. 14, 2018. The entire contents of the above-identified applications are hereby fully incorporated herein by reference.

REFERENCE TO AN ELECTRONIC SEQUENCE LISTING

The contents of the electronic sequence listing (BROD_2344_ST25.txt," 1,088,282 bytes, created on Oct. 4, 2018) is herein incorporated by reference in its entirety.

STATEMENT REGARDING FEDERALLY SPONSORED RESEARCH

This invention was made with government support under grant numbers MH110049 and HL141201 granted by the National Institutes of Health. The government has certain rights in the invention.

TECHNICAL FIELD

The subject matter disclosed herein is generally directed to rapid diagnostics related to the use of CRISPR effector systems.

BACKGROUND

Nucleic acids are a universal signature of biological information. The ability to rapidly detect nucleic acids with high sensitivity and single-base specificity on a portable platform has the potential to revolutionize diagnosis and monitoring for many diseases, provide valuable epidemiological information, and serve as a generalizable scientific tool. Although many methods have been developed for detecting nucleic acids (Du et al., 2017; Green et al., 2014; Kumar et al., 2014; Pardee et al., 2014; Pardee et al., 2016; Urdea et al., 2006), they inevitably suffer from trade-offs among sensitivity, specificity, simplicity, and speed. For example, qPCR approaches are sensitive but are expensive and rely on complex instrumentation, limiting usability to highly trained operators in laboratory settings. Other approaches, such as new methods combining isothermal nucleic acid amplification with portable platforms (Du et al., 2017; Pardee et al., 2016), offer high detection specificity in a point-of-care (POC) setting, but have somewhat limited applications due to low sensitivity. As nucleic acid diagnostics become increasingly relevant for a variety of healthcare applications, detection technologies that provide high specificity and sensitivity at low cost would be of great utility in both clinical and basic research settings.

SUMMARY

In one aspect, the invention provides a lateral flow device comprising a substrate. The substrate may comprise a first end, wherein the first end comprises a sample loading portion. The first end may further comprise a first region loaded with a detectable ligand, a CRISPR effector system, a detection construct, a first test band comprising a biotin ligand, and a second test band comprising a capture molecule for the detectable ligand. The detection construct may comprise an RNA oligonucleotide, having a first molecule on a first end and a second molecule on a second end. In certain embodiments, the first molecule may be FITC and the second molecule may be FAM.

The lateral flow device may further comprise a cleavable reporter construct comprising a first molecule and a second molecule linked by an RNA or DNA linker. In some embodiments, the first molecule may be FITC and the second molecule may be biotin, or vice versa. The lateral flow device may further comprise a first capture region, which, in some embodiments, may be a first horizontal line running across the device. In specific embodiments, the first capture region is proximate to and on the same end of the lateral flow substrate as the sample loading portion, and may comprise a first binding agent that specifically binds the first molecule of the reporter construct. In some embodiments, the first binding agent may be an antibody, such as an anti-FITC antibody for example, which is fixed or otherwise immobilized to the first capture region. The lateral flow device may further comprise a second capture region, which, in some embodiments, is located towards the opposite end of the lateral flow substrate from the first binding region. In specific embodiments, the second capture region may comprise a second binding agent that specifically binds the second molecule of the reporter construct. In some embodiments, the second binding agent may be an antibody, such as an anti-biotin antibody for example, which is fixed or otherwise immobilized to the second capture region.

In some embodiments, the detectable ligand may be a gold nanoparticle, which may be modified with a first antibody. In specific embodiments, the first antibody may be an anti-FITC antibody. In some embodiments, the CRISPR effector system may comprise a CRISPR effector protein and one or more guide sequences configured to bind to one or more target sequences.

In some embodiments, the substrate may be a flexible materials substrate, such as a paper substrate or a flexible polymer based substrate for example.

In certain example embodiments CRISPR effector protein may be an RNA-targeting effector protein. In certain embodiments, RNA targeting effector protein may be a Cas13. In specific embodiments, the Cas13 may be within 20 kb of a Cas 1 gene. The Cas13 effector protein may be an organism of a genus selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter*, and *Lachnospira*. In specific embodiments, the C2c2 or Cas13b effector protein may be from an organism selected from the group consisting of: *Leptotrichia shahii; Leptotrichia wadei* (Lw2); *Listeria seeligeri; Lachnospiraceae bacterium* MA2020; *Lachnospiraceae bacterium* NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; *Listeriaceae bacterium* FSL M6-0635; *Leptotrichia wadei* F0279; *Rhodobacter capsulatus* SB 1003; *Rhodobacter capsulatus*

R121; *Rhodobacter capsulatus* DE442; *Leptotrichia buccalis* C-1013-b; *Herbinix hemicellulosilytica*; [*Eubacterium*] rectale; *Eubacteriaceae bacterium* CHKCI004; *Blautia* sp. Marseille-P2398; and *Leptotrichia* sp. oral taxon 879 str. F0557, Twelve (12) further non-limiting examples are: *Lachnospiraceae bacterium* NK4A 144; *Chloroflexus aggregans*; *Demequina aurantiaca*; *Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae*; *Porphyromonadaceae bacterium* KH3CP3RA; *Listeria riparia*; and *Insolitispirillum peregrinum*. In an exemplary embodiment, the C2c2 effector protein is a *L. wadei* F0279 or *L. wadei* F0279 (Lw2) C2c2 effector protein.

In certain example embodiments, the CRISPR-Cas effector protein may be a Cas12 protein, such as Cpf1 or C2c1.

In certain example embodiments, the assay or device may comprise multiple Cas 13 orthologs, multiple Cas12 orthologs, or a combination of Cas13 and Cas12 orthologs.

The one or more guide sequences may comprise one or more guide RNAs, which may be designed to bind to one or more target molecules that are diagnostic for a disease state. Such disease states may include, but are not necessarily limited to, cancer, autoimmune diseases, infections, organ diseases, blood diseases, immune system diseases, brain and nervous system diseases, endocrine diseases, pregnancy or childbirth-related diseases, inherited diseases, or environmentally-acquired diseases.

In some embodiments, the disease state may be characterized by the presence or absence of an antibiotic or drug resistance or susceptibility gene or transcript or polypeptide, preferably in a pathogen or a cell.

In some embodiments, the infection may be caused by a virus, a bacterium, a fungus, a protozoan, or a parasite. In embodiments where the infection is viral, it may be caused by a DNA virus. In specific embodiments, the DNA virus may include, but is not necessarily limited to members of the Myoviridae, Podoviridae, Siphoviridae, Alloherpesviridae, Herpesviridae (including human herpes virus, and Varicella Zorter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, or Rhizidovirus.

A viral infection may also be caused by a double-stranded RNA virus, a positive sense RNA virus, a negative sense RNA virus, a retrovirus, or a combination thereof. A viral infection may further be caused by a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. A viral infection may further be caused by Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In other embodiments, the infection may be bacterial in nature. The bacterium causing the bacterial infection may include, but is not necessarily limited to, *Acinetobacter* species, *Actinobacillus* species, *Actinomycetes* species, an *Actinomyces* species, *Aerococcus* species an *Aeromonas* species, an *Anaplasma* species, an *Alcaligenes* species, a *Bacillus* species, a *Bacteroides* species, a *Bartonella* species, a *Bifidobacterium* species, a *Bordetella* species, a *Borrelia* species, a *Brucella* species, a *Burkholderia* species, a *Campylobacter* species, a *Capnocytophaga* species, a *Chlamydia* species, a *Citrobacter* species, a *Coxiella* species, a *Corynbacterium* species, a *Clostridium* species, an *Eikenella* species, an *Enterobacter* species, an *Escherichia* species, an *Enterococcus* species, an *Ehlichia* species, an *Epidermophyton* species, an *Erysipelothrix* species, a *Eubacterium* species, a *Francisella* species, a *Fusobacterium* species, a *Gardnerella* species, a *Gemella* species, a *Haemophilus* species, a *Helicobacter* species, a *Kingella* species, a *Klebsiella* species, a *Lactobacillus* species, a *Lactococcus* species, a *Listeria* species, a *Leptospira* species, a *Legionella* species, a *Leptospira* species, *Leuconostoc* species, a *Mannheimia* species, a *Microsporum* species, a *Micrococcus* species, a *Moraxella* species, a *Morganell* species, a *Mobiluncus* species, a *Micrococcus* species, *Mycobacterium* species, a *Mycoplasm* species, a *Nocardia* species, a *Neisseria* species, a *Pasteurelaa* species, a *Pediococcus* species, a *Peptostreptococcus* species, a *Pityrosporum* species, a *Plesiomonas* species, a *Prevotella* species, a *Porphyromonas* species, a *Proteus* species, a *Providencia* species, a *Pseudomonas* species, a *Propionibacteriums* species, a *Rhodococcus* species, a *Rickettsia* species, a *Rhodococcus* species, a *Serratia* species, a *Stenotrophomonas* species, a *Salmonella* species, a *Serratia* species, a *Shigella* species, a *Staphylococcus* species, a *Streptococcus* species, a *Spirillum* species, a *Streptobacillus* species, a *Treponema* species, a *Tropheryma* species, a *Trichophyton* species, an *Ureaplasma* species, a *Veillonella* species, a *Vibrio* species, a *Yersinia* species, a *Xanthomonas* species, or combination thereof.

In other embodiments, the infection may be fungal, and may be caused by fungi such as, but not necessarily limited to, *Aspergillus, Blastomyces, Candidiasis, Coccidiodomycosis, Cryptococcus neoformans, Cryptococcus gatti*, sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucroymcosis, Sporothrix*, fungal eye infections ringworm, *Exserohilum, Cladosporium, Geotrichum, Saccharomyces*, a *Hansenula* species, a *Candida* species, a *Kluyveromyces* species, a *Debaryomyces* species, a *Pichia* species, a *Penicillium* species, a *Cladosporium* species, a *Byssochlamys* species or a combination thereof.

In other embodiments, the infection may be caused by a protozoan, such as *Euglenozoa*, a *Heterolobosea*, a *Diplomonadida*, an *Amoebozoa*, a *Blastocystic*, an *Apicomplexa*, or combination thereof.

In other embodiments, the infection may be caused by a parasite, such as, but not necessarily limited to, *Trypanosoma cruzi* (Chagas disease), *T. brucei gambiense, T. brucei rhodesiense, Leishmania braziliensis, L. infantum, L. mexicana, L. major, L. tropica, L. donovani, Naegleria fowleri, Giardia intestinalis* (*G. lamblia, G. duodenalis*), *canthamoeba castellanii, Balamuthia madrillaris, Entamoeba histolytica, Blastocystic hominis, Babesia microti, Cryptosporidium parvum, Cyclospora cayetanensis, Plasmodium*

*falciparum, P. vivax, P. ovale, P. malariae*, and *Toxoplasma gondii*, or a combination thereof.

In some embodiments, the sample may be a biological sample or an environmental sample. Biological samples may include, but are not necessarily limited to, blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface.

In certain embodiments, environmental samples may include, but are not necessarily limited to, samples obtained from a food sample, paper surface, a fabric, a metal surface, a wood surface, a plastic surface, a soil sample, a fresh water sample, a waste water sample, a saline water sample, or a combination thereof.

In another aspect, the invention provides a lateral flow device comprising a substrate with a first end, wherein the first end comprises a sample loading portion and a first region loaded with a detectable ligand, two or more CRISPR effector systems, two or more detection constructs, one or more first capture regions, each comprising a first binding agent, two or more second capture regions, each comprising a second binding agent, wherein each of the two or more CRISPR effector systems comprises a CRISPR effector protein and one or more guide sequences, each guide sequence configured to bind one or more target molecules.

In some embodiments, each of the two or more detection constructs comprises an RNA or DNA oligonucleotide, comprising a first molecule on a first end and a second molecule on a second end. In specific embodiments, the lateral flow device may comprise two CRISPR effector systems and two detection constructs. In even more specific embodiments, the lateral flow device may comprise four CRISPR effector systems and four detection constructs.

The sample loading portion may further comprise one or more amplification reagents to amplify the one or more target molecules.

In some embodiments, a first detection construct comprises FAM as a first molecule and biotin as a second molecule or vice versa and a second detection construct comprises FAM as a first molecule and Digoxigenin (DIG) as a second molecule or vice versa. In some embodiments, the CRISPR effector protein is an RNA-targeting effector protein. In some embodiments, the RNA-targeting effector protein is C2c2. In some embodiments, the RNA-targeting effector protein is Cas13b.

In some embodiments, a first detection construct may comprise Tye665 as a first molecule and Alexa-fluor-488 as a second molecule or vice versa; a second detection construct may comprise Tye665 as a first molecule and FAM as a second molecule or vice versa; a third detection construct may comprise Tye665 as a first molecule and biotin as a second molecule or vice versa; and a fourth detection construct may comprise Tye665 as a first molecule and DIG as a second molecule or vice versa.

In some embodiments, the CRISPR effector protein may be an RNA-targeting or a DNA-targeting effector protein. The RNA targeting effector may be C2c2 or Cas13b. In some embodiments, the DNA-targeting effector protein is Cas12a.

In another aspect, the invention provides a method for detecting a target nucleic acid in a sample, comprising contacting a sample with the first end of the lateral flow device described herein. Preferably, the sample is contacted with the sample loading portion of the device, and the sample flows from the sample loading portion of the substrate towards the first and second capture regions, thereby generating a detectable signal.

The sample may be a liquid sample, or it may be dissolved in an aqueous solvent. In embodiments in which the sample does not contain target nucleic acid, the detectable signal appears at the first capture region. In embodiments in which the sample does contain target nucleic acid, the detectable signal appears at the second capture region. The presence of target nucleic acid is typically indicative of a disease state.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

FIG. 31—provides a set of graphs providing (A) a schematic of Zika RNA detection in accordance with certain example embodiments. Lentivirus was packaged with Zika RNA or homologous Dengue RNA fragments targeted by C2c2 collateral detection. Media is harvested after 48 hours and subjected to thermal lysis, RT-RPA, and C2c2 detection. (B) RT-RAP-C2c2 detection is capable of highly sensitive detection of the Zika lentiviral particles (n=4 technical replicates, two-tailed Student t-test;***, p<0.0001; bars represent mean±s.e.m.) (C) A schematic of Zika RNA detection using freeze-dried C2c2 on paper, in accordance with certain example embodiments. (D) The paper-based assay is capable of highly sensitive detection of Zika lentiviral particles (n-4 technical replicates, two-tailed Student t-test; , p<0.0001; , p<0.01, bars represent mean±s.e.m.).

FIG. 35—provides a set of graphs demonstrating (A) detection of two different carbapenem-resistance genes (KPC and NDM-1) from four different clinical isolates of

*Klebsiella pneumoniae*, and (B) detection of carbapenem-resistance genes (part A) is normalized as a ratio of signal between the KPC and NDM-1 crRNA assays (n=2 technical replicates, two-tailed Student t-test; ****, p<0.0001; bars represent mean±s.e.m.).

FIG. 36—provides a set of graphs demonstrating that (A) C2c2 is not sensitive to single mismatches, but can distinguish between single nucleotide differences in target when loaded with crRNAs with additional mismatches. ssRNA targets 1-3 were detected with 11 crRNAs, with 10 spacers containing synthetic mismatches at various positions in the crRNA. Mismatched spacers did not show reduced cleavage of target 1, but showed inhibited cleavage of mismatch targets 2 and 3 (SEQ. I.D. Nos. 224 through 237). (B) Schematic showing the process for rational design of single-base specific spacers with synthetic mismatches. Synthetic mismatches are placed in proximity to the SNP or base of interest (SEQ. I.D. Nos. 238 through 242). (C) Highly specific detection of strain SNPs allows for the differentiation of Zika African versus American RNA targets differing by only one nucleotide using C2c2 detection with truncated (23 nucleotide) crRNAs (n=2 technical replicates, one-tailed Student t-test; *, p<0.05; ****, p<0.0001; bars represent mean±s.e.m.).

Figure 37:
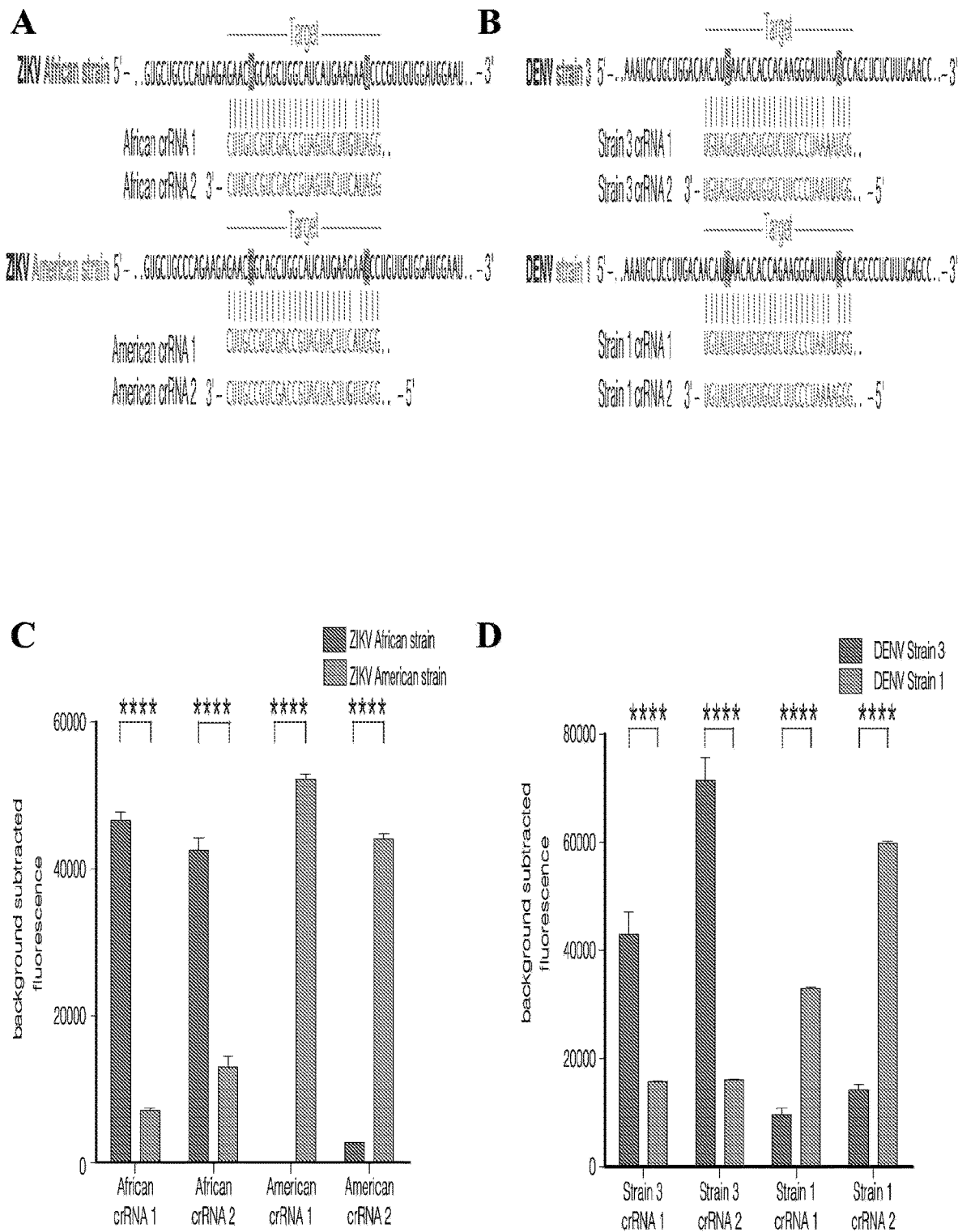

FIG. 37—provides a set of graphs demonstrating: (A) Schematic of Zika strain target regions and the crRNA sequences used for detection (SEQ. I.D. Nos. 243 through 248). SNPs in the target are highlighted red or blue and synthetic mismatches in the guide sequence are colored red. (B) Highly specific detection of strain SNPs allows for the differentiation of Zika African versus American RNA targets using SHERLOCK (n=2 technical replicates, two-tailed Student t-test; **, p<0.0001; bars represent mean±s.e.m.) (SEQ. I.D. Nos. 249 through 254). (C) Schematic of Dengue strain target regions and the crRNA sequences used for detection. SNPs in the target are highlighted red or blue and synthetic mismatches in the guide sequence are colored red. (D) Highly specific detection of strain SNPs allows for the differentiation of Dengue strain 1 versus strain 3 RNA targets using SHERLOCK (n=2 technical replicates, two-tailed Student t-test; **, p<0.0001; bars represent mean±s.e.m.).

Figure 38:
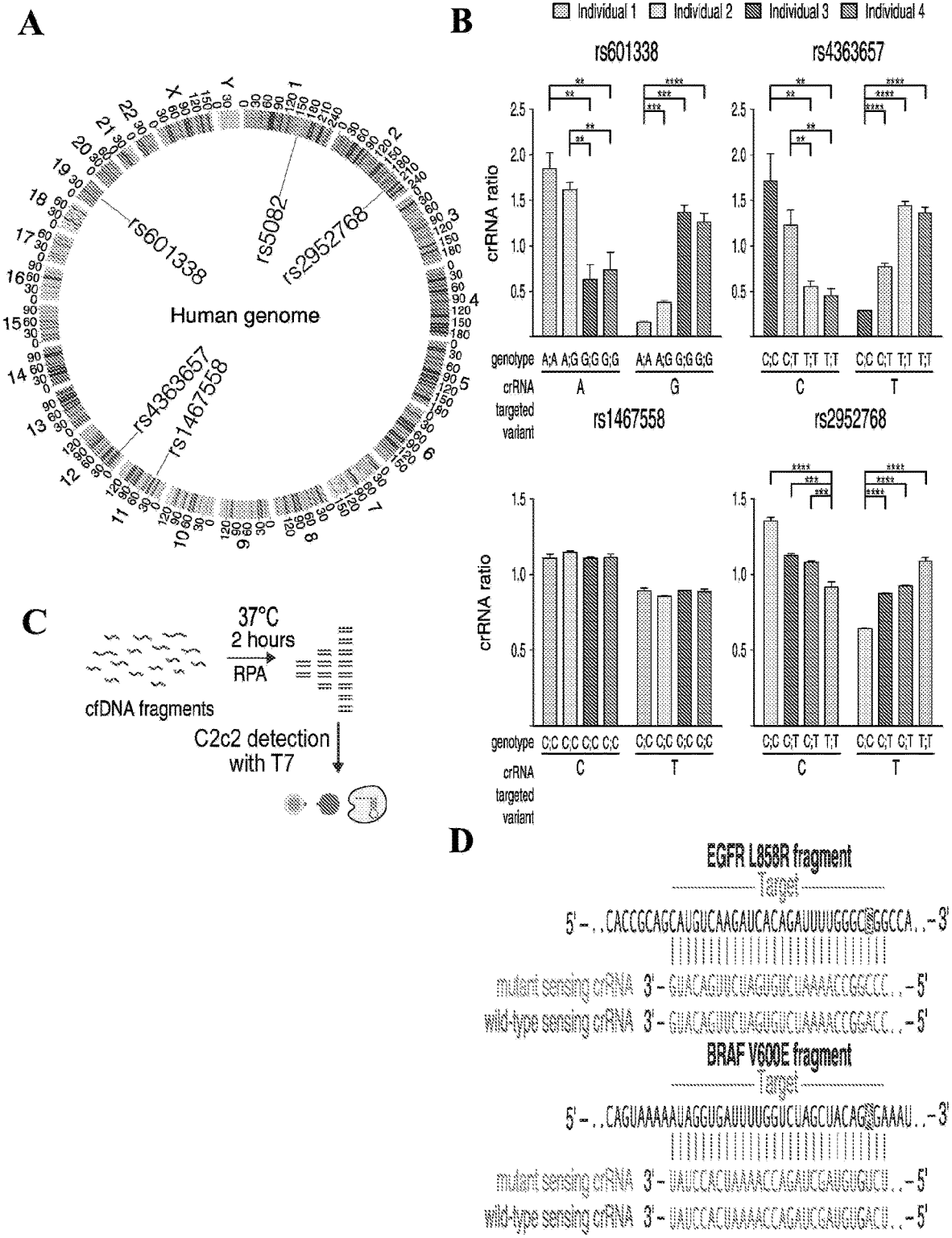

FIG. 38—provides a set of graphs showing (A) circos plot showing location of human SNPs detected with C2c2. (B) The assay conducted in accordance with certain example embodiments can distinguish between human SNPs. SHERLOCK can correctly genotype four different individuals at four different SNP sites in the human genome. The genotypes for each individual and identities of allele-sensing crRNAs are annotated below each plot (n=4 technical replicates; two-tailed Student t-test; *, p<0.05; , p<0.01; *, p<0.001; ****, p<0.0001; bars represent mean±s.e.m.). (C) A schematic of process for detection of cfDNA (such as cell free DNA detection of cancer mutations) in accordance with certain example embodiments. (D) Example crRNA sequences for detecting EGFR L858R and BRAF V600E (SEQ. I.D. Nos. 255 through 260). Sequences of two genomic loci assayed for cancer mutations in cell-free DNA. Shown are the target genomic sequence with the SNP highlighted in blue and the mutant/wildtype sensing crRNA sequences with synthetic mismatches colored in red.

FIG. 39—provides a set of graphs demonstrating that C2c2 can detect the mutant minor allele in mock cell-free DNA samples from the EGFR L858R (C) or the BRAF V600E (B) minor allele (n=4 technical replicates, two tailed Student t-test; *, p<0.05; , p<0.01, **, P<0.0001; bars represent ±s.e.m.).

Figure 40:
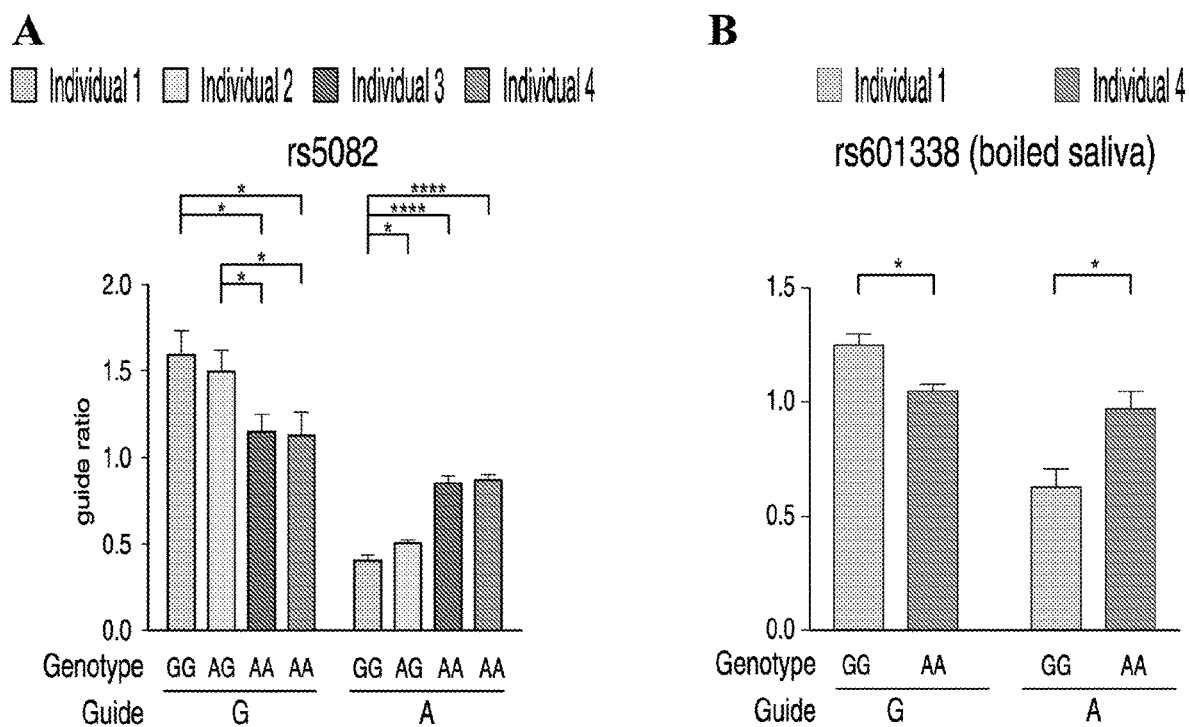

FIG. 40—provides a set of graphs demonstrating that (A) the assay can distinguish between genotypes at rs5082 (n=4 technical replicates; *, p<0.05; , p<0.01; *, p<0.001; ****, p<0.0001; bars represent mean±s.e.m.). (B) the assay can distinguish between genotypes at rs601338 in gDNA directly from centrifuged, denatured, and boiled saliva (n=3 technical replicates; *, p<0.05; bars represent mean±s.e.m.).

Figure 41:
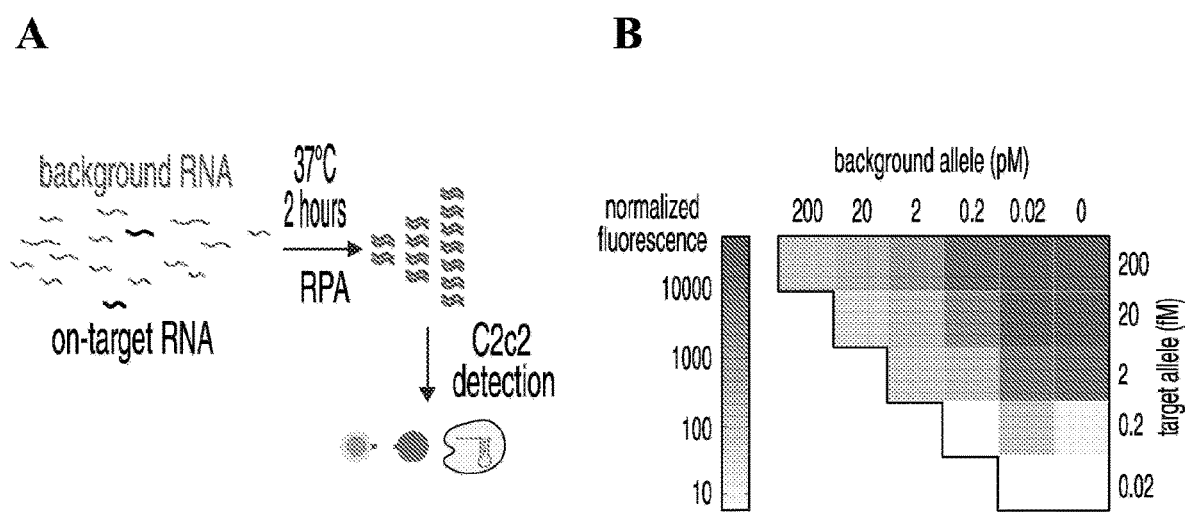

FIG. 41—provides (A) a schematic of an example embodiment performed on ssDNA 1 in the background of a target that differs from ssDNA 1 by only a single mismatch. (B) The assay achieves single nucleotide specificity detection of ssDNA 1 in the presence of mismatched background (target that differs by only a single mismatch from ssDNA). Various concentrations of target DNA were combined with a background excess of DNA with one mismatch and detected by the assay.

Figure 42:
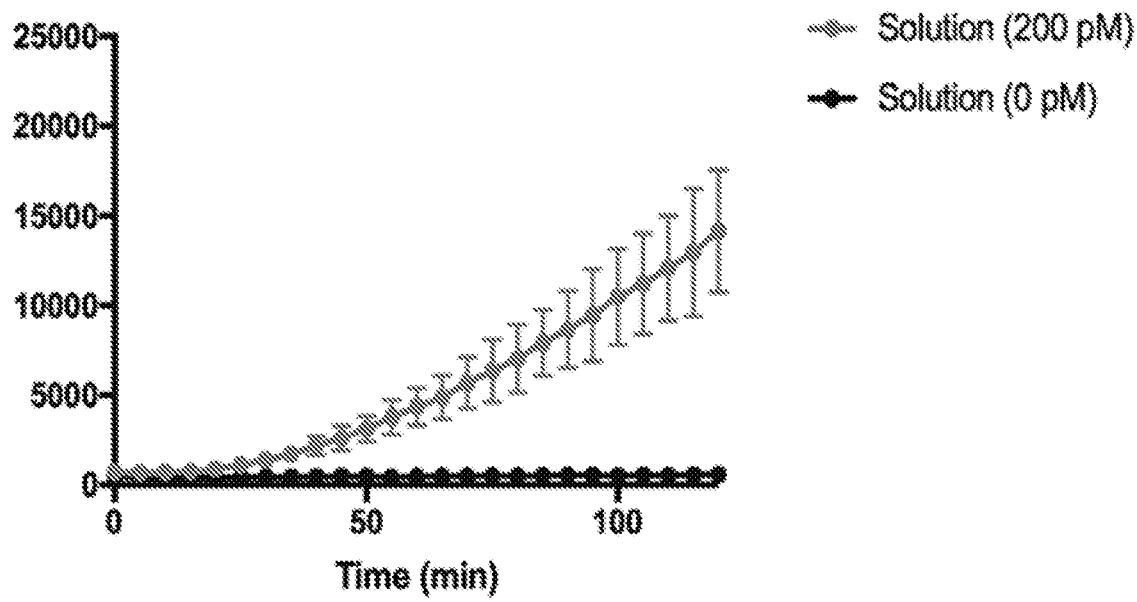

FIG. 42 is a graph showing a masking construct with a different dye Cy5 also allows for effective detection.

Figure 43:
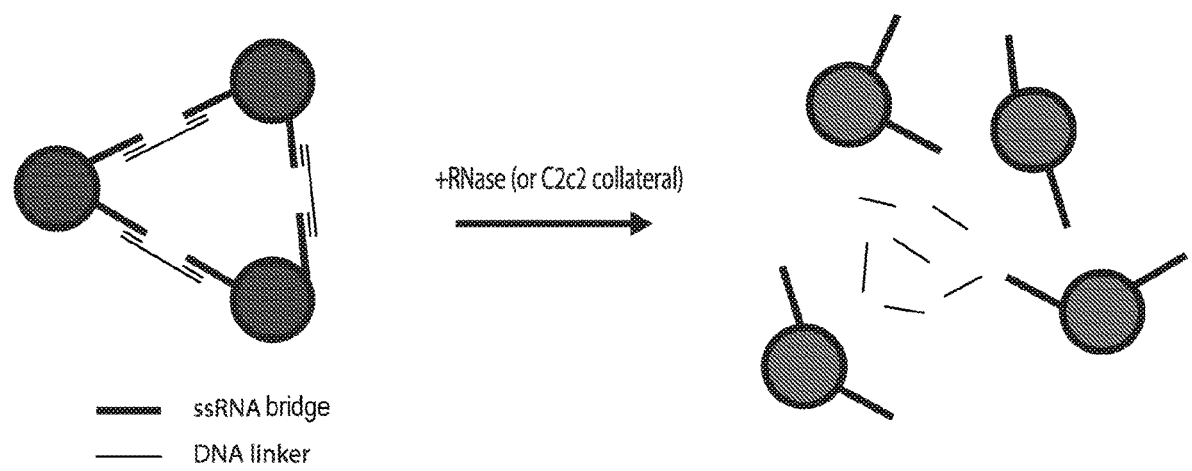

FIG. 43 is a schematic of a gold nanoparticle colorimetric based assay. AuNPs are aggregated using a combination of DNA linkers and an RNA bridge. Upon addition of RNase activity, the ssRNA bridge is cleaved and the AuNPs are released, causing a characteristic color shifts toward red.

Figure 44:
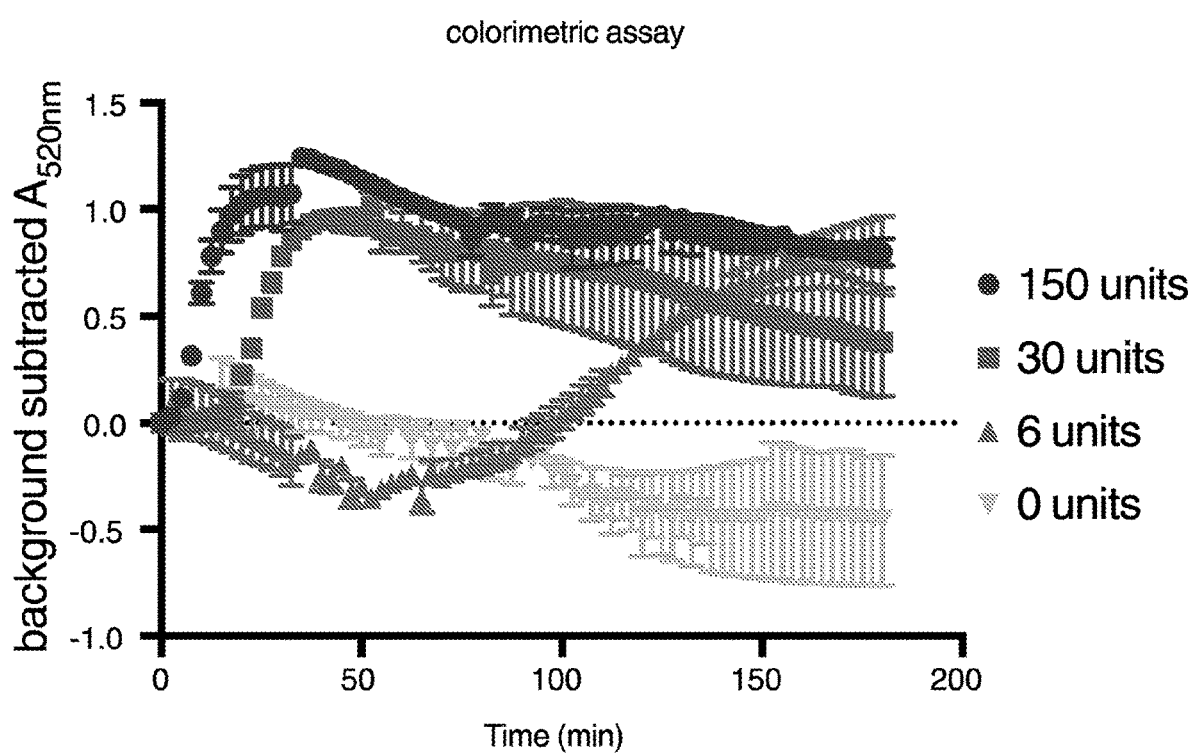

FIG. 44 is a graph showing the ability to detect the shift in color of dispersed nanoparticles at 520 nm. The nanoparticles were based on the example embodiment shown in FIG. 43 and dispersed using addition of RNase A at varying concentrations.

Figure 45:
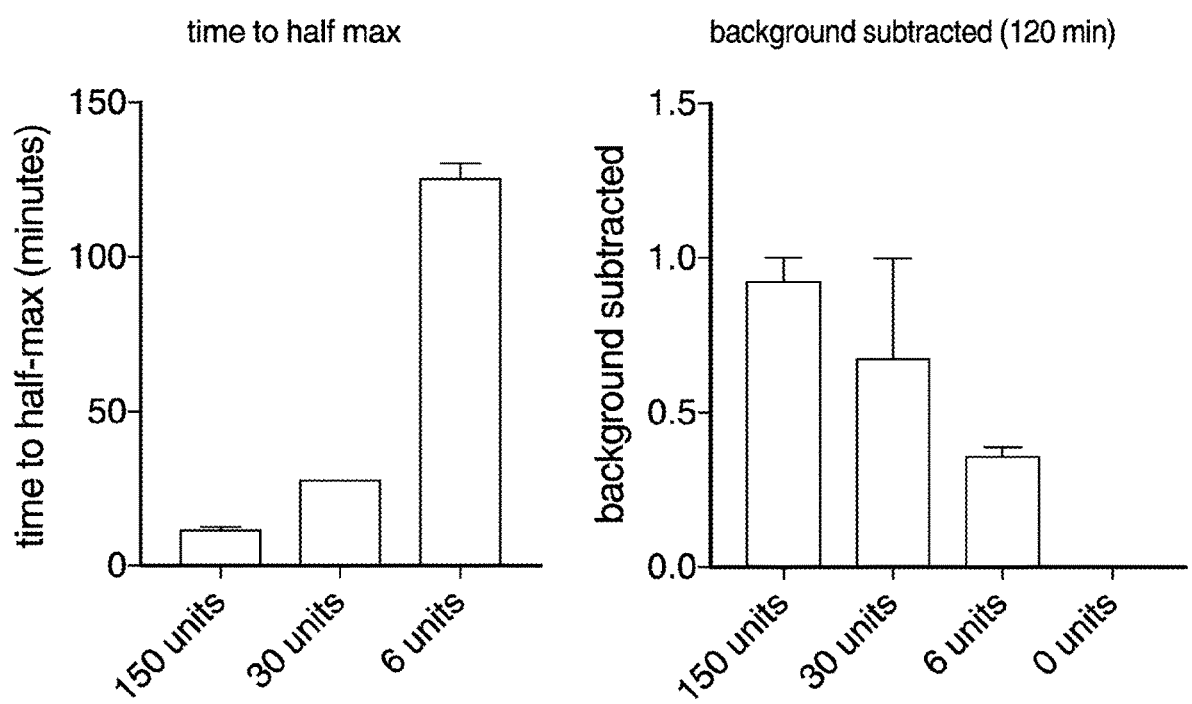

FIG. 45 is a graph showing that the RNase colorimetric test is quantitative.

Figure 46:
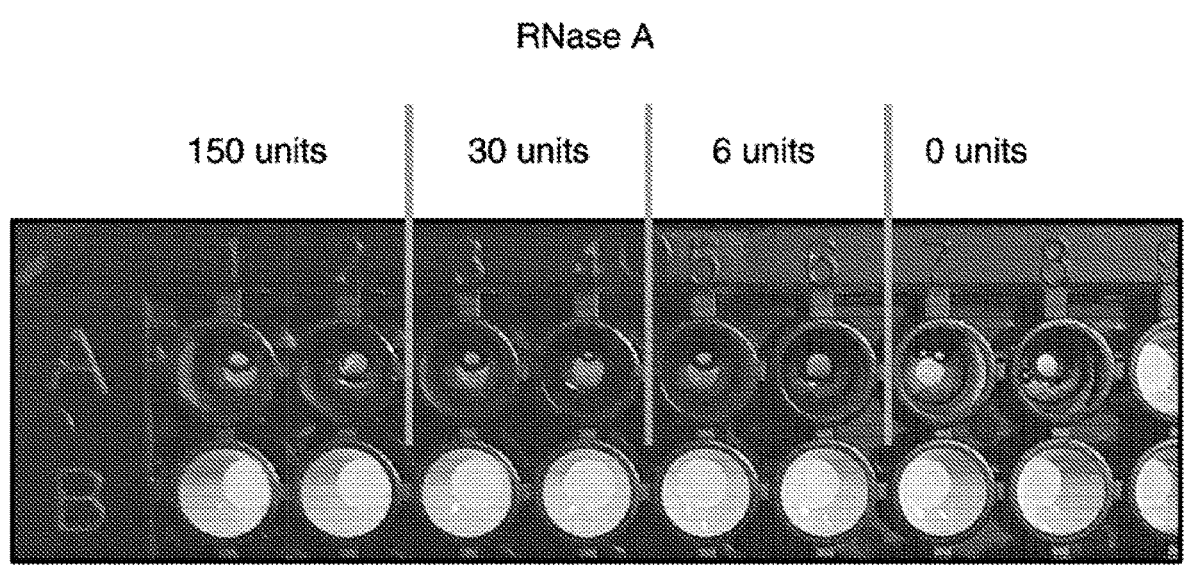

FIG. 46 is a picture of a microwell plate showing that the color shift in the dispersed nanoparticle is visually detectable.

FIG. 47 is a picture demonstrating that the colorimetric shift is visible on a paper substrate. The test was performed for 10 minutes at 37 degrees C. on glass fiber 934-AH.

Figure 48:
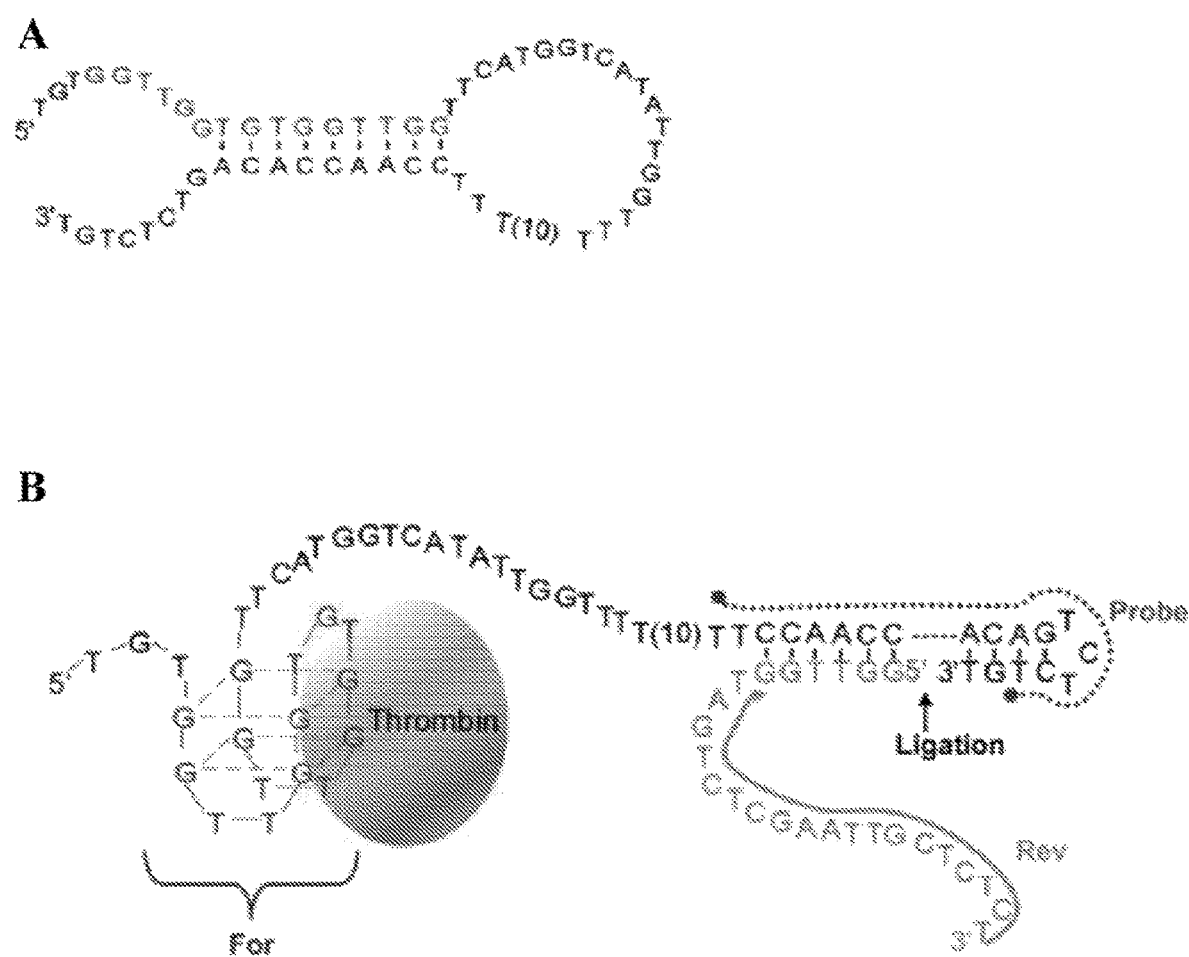

FIG. 48 is a schematic of a conformation switching aptamers in accordance with certain example embodiments for detection of protein or small molecules. (A) SEQ ID NO:261. The ligated product (B) is used as a complete target for the RNA-targeting effector, which cannot detect the unligated input product (SEQ ID NO:262).

Figure 49:
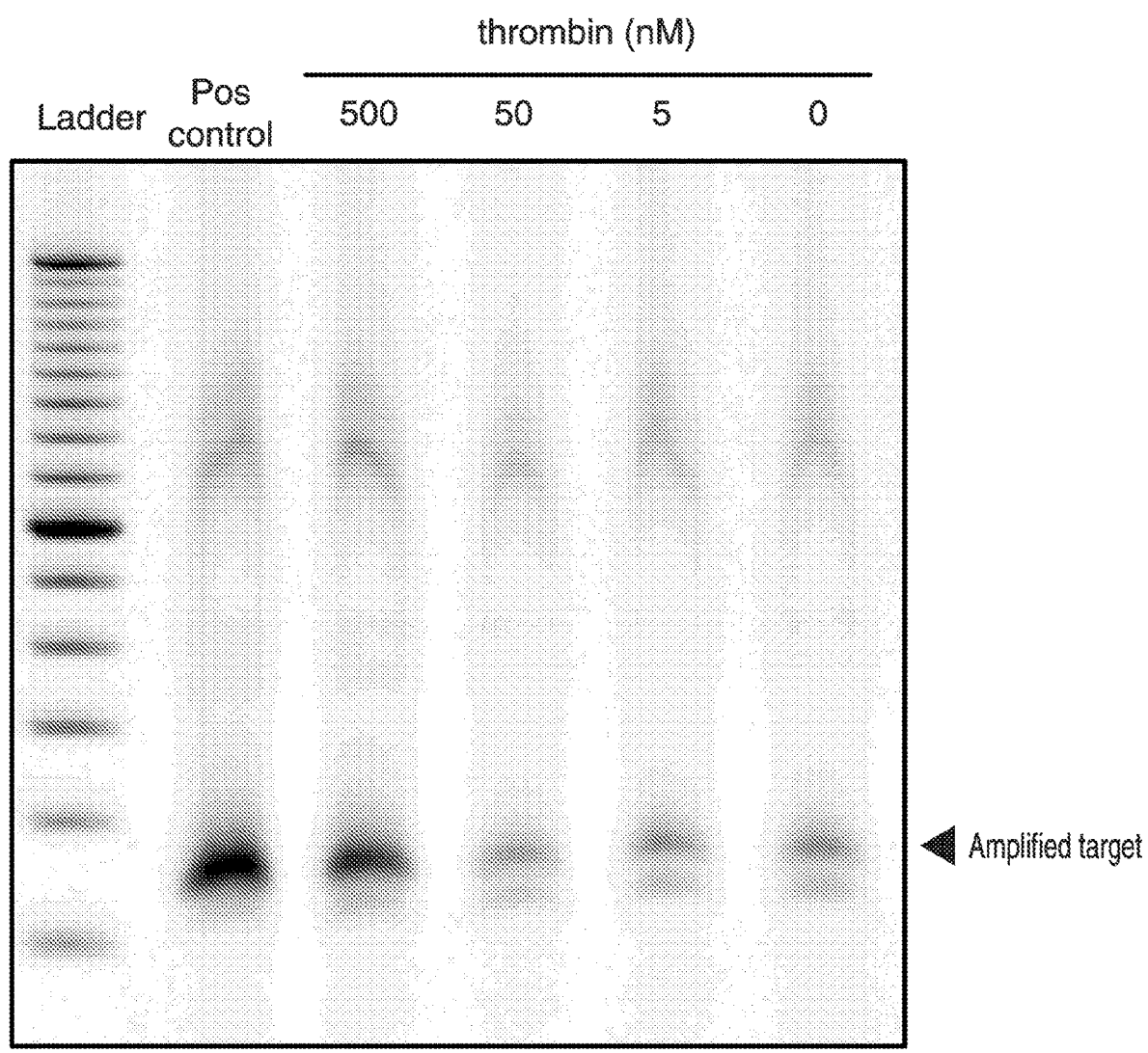

FIG. 49 is an image of a gel showing that aptamer-based ligation can create RPA-detectable substrates. Aptamers were incubated with various levels of thrombin and then ligated with probe. Ligated constructs were used as templates for a 3 minute RPA reaction. 500 nM thrombin has significantly higher levels of amplified target than background.

FIG. 50 shows the amino acid sequence of the HEPN domains of selected C2c2 orthologues (SEQ ID NO:263-292).

Figure 51:
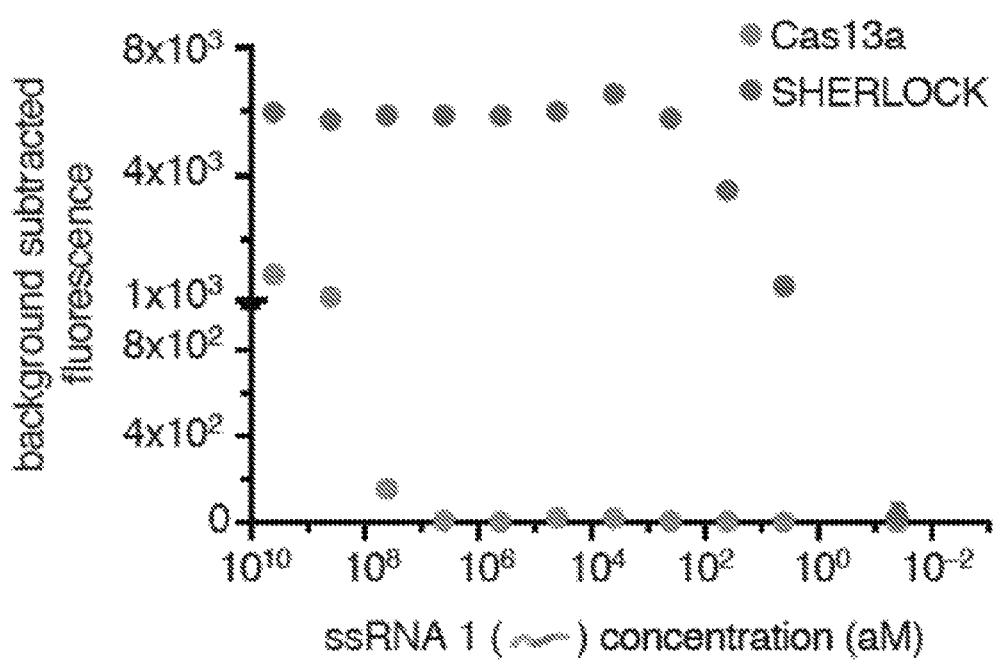

FIG. 51 Cas13a detection of RNA with RPA amplification (SHERLOCK) can detect ssRNA target at concentrations down to ~2 aM, more sensitive than Cas13a alone (n=4 technical replicates; bars represent mean±s.e.m.).

FIG. 52—Cas13a detection can be used to sense viral and bacterial pathogens. (A) Schematic of SHERLOCK detection of ZIKV RNA isolated from human clinical samples. (B) SHERLOCK is capable of highly sensitive detection of human ZIKV-positive serum (S) or urine (U) samples. Approximate concentrations of ZIKV RNA shown were determined by qPCR (n=4 technical replicates, two-tailed Student t-test; ****, p<0.0001; bars represent mean±s.e.m.; n.d., not detected).

Figure 53:
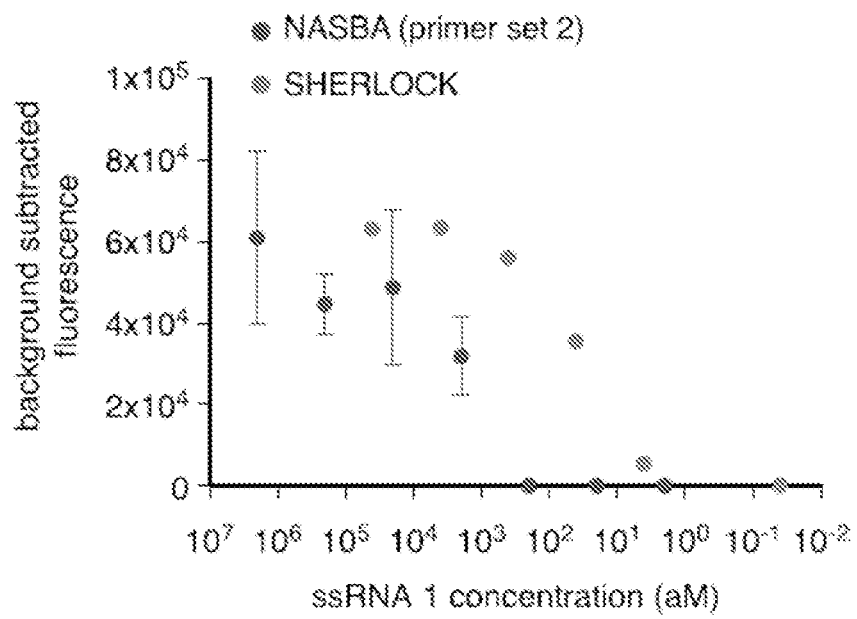

FIG. 53—Comparison of detection of ssRNA 1 by NASBA with primer set 2 (of FIG. 11) and SHERLOCK (n=2 technical replicates; bars represent mean±s.e.m.).

Figure 54:
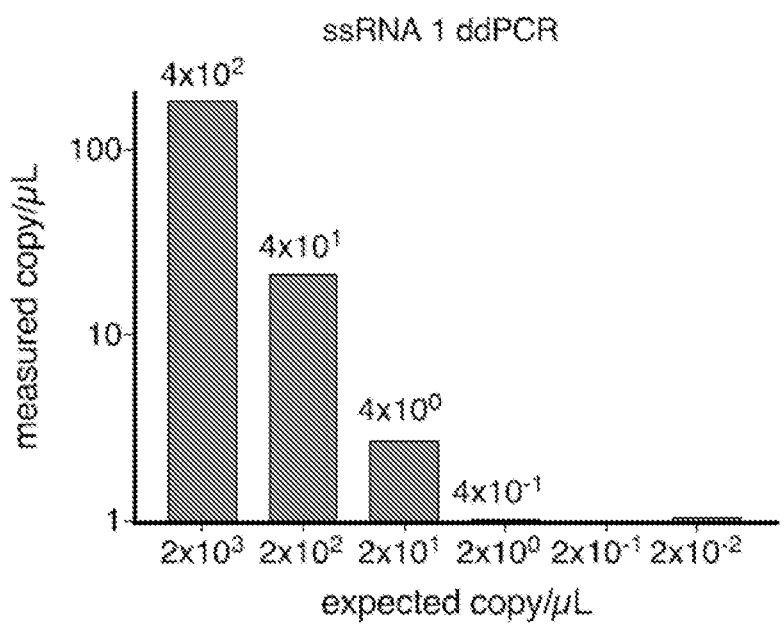

FIG. 54 Nucleic acid amplification with RPA and single-reaction SHERLOCK. (A) Digital-droplet PCR quantitation of ssRNA 1 for dilutions used in FIG. 1C. Adjusted concentrations for the dilutions based on the ddPCR results are shown above bar graphs. (B) Digital-droplet PCR quantitation of ssDNA 1 for dilutions used in FIG. 1D. Adjusted concentrations for the dilutions based on the ddPCR results are shown above bar graphs. (C) The RPA, T7 transcription, and Cas13a detection reactions are compatible and achieve single molecule detection of DNA 2 when incubated simultaneously (n=3 technical replicates, two-tailed Student t-test; n.s., not significant; , $p<0.01$; **, $p<0.0001$; bars represent mean±s.e.m.).

FIG. 55—Comparison of SHERLOCK to other sensitive nucleic acid detection tools. (A) Detection analysis of ssDNA 1 dilution series with digital-droplet PCR (n=4 technical replicates, two-tailed Student t-test; n.s., not significant; *, $p<0.05$; , $p<0.01$; , $p<0.0001$; red lines represent mean, bars represent mean±s.e.m. Samples with measured copy/μL below 10-1 not shown.). (B) Detection analysis of ssDNA 1 dilution series with quantitative PCR (n=16 technical replicates, two-tailed Student t-test; n.s., not significant; , $p<0.01$; ****, $p<0.0001$; red lines represent mean, bars represent mean±s.e.m. Samples with relative signal below 10-10 not shown.). (C) Detection analysis of ssDNA 1 dilution series with RPA with SYBR Green II (n=4 technical replicates, two-tailed Student t-test; *, $p<0.05$; , $p<0.01$; red lines represent mean, bars represent mean±s.e.m. Samples with relative signal below 100 not shown.). (D) Detection analysis of ssDNA 1 dilution series with SHERLOCK (n=4 technical replicates, two-tailed Student t-test; , $p<0.01$; ****, $p<0.0001$; red lines represent mean, bars represent mean s.e.m. Samples with relative signal below 100 not shown.). (E) Percent coefficient of variation for a series of ssDNA 1 dilutions for four types of detection methods. (F) Mean percent coefficient of variation for the 6e2, 6e1, 6e0, and 6e-1 ssDNA 1 dilutions for four types of detection methods (bars represent mean±s.e.m.)

Figure 56:
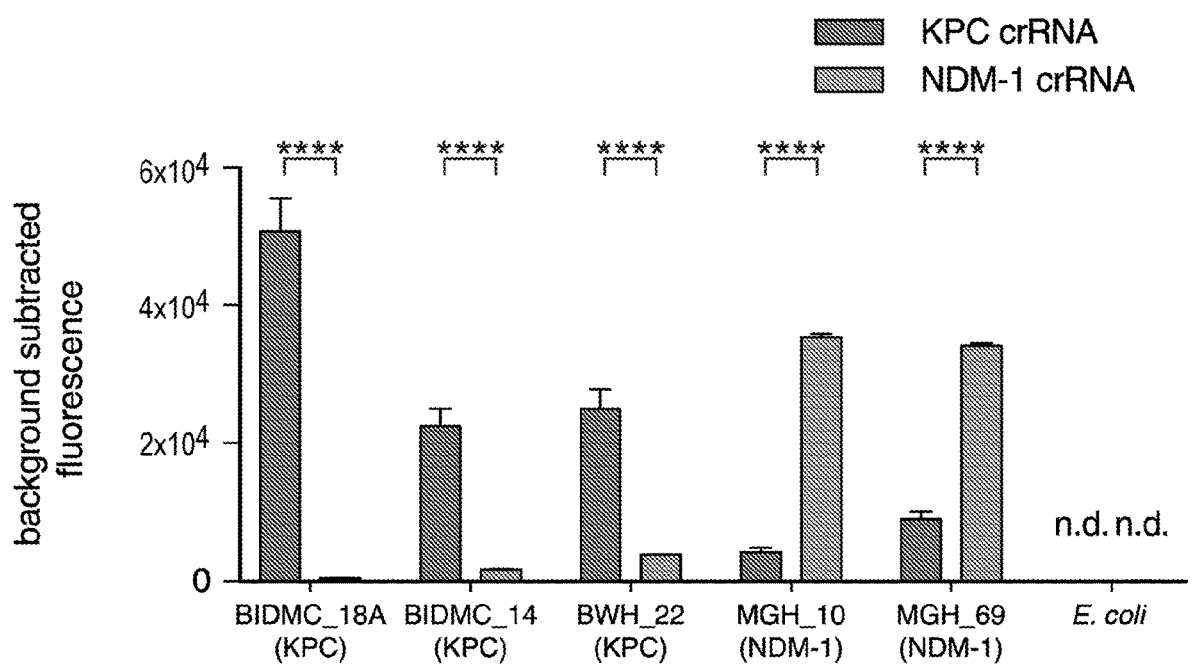

FIG. 56—Detection of carbapenem resistance in clinical bacterial isolates. Detection of two different carbapenem-resistance genes (KPC and NDM-1) from five clinical isolates of *Klebsiella pneumoniae* and an *E. coli* control (n=4 technical replicates, twotailed Student t-test; ****, $p<0.0001$; bars represent mean±s.e.m.; n.d., not detected).

FIG. 57—Characterization of LwCas13a sensitivity to truncated spacers and single mismatches in the target sequence. (A) Sequences of truncated spacer crRNAs used in (B)-(G). Also shown are sequences of ssRNA 1 and 2, which has a single base-pair difference highlighted in red. crRNAs containing synthetic mismatches are displayed with mismatch positions colored in red (SEQ ID NO:293-304). (B) Collateral cleavage activity on ssRNA 1 and 2 for 28 nt spacer crRNA with synthetic mismatches at positions 1-7 (n=4 technical replicates; bars represent mean s.e.m.). (C) Specificity ratios of crRNA tested in (B). Specificity ratios are calculated as the ratio of the on-target RNA (ssRNA 1) collateral cleavage to the off-target RNA (ssRNA 2) collateral cleavage (n=4 technical replicates; bars represent mean±s.e.m.). (D) Collateral cleavage activity on ssRNA 1 and 2 for 23 nt spacer crRNA with synthetic mismatches at positions 1-7 (n=4 technical replicates; bars represent mean±s.e.m.). (E) Specificity ratios of crRNA tested in (D). Specificity ratios are calculated as the ratio of the on-target RNA (ssRNA 1) collateral cleavage to the off-target RNA (ssRNA 2) collateral cleavage (n=4 technical replicates; bars represent mean s.e.m.). (F) Collateral cleavage activity on ssRNA 1 and 2 for 20 nt spacer crRNA with synthetic mismatches at positions 1-7 (n=4 technical replicates; bars represent mean±s.e.m.). (G) Specificity ratios of crRNA tested in (F). Specificity ratios are calculated as the ratio of the on-target RNA (ssRNA 1) collateral cleavage to the off-target RNA (ssRNA 2) collateral cleavage (n=4 technical replicates; bars represent mean±s.e.m.).

FIG. 58.—Identification of ideal synthetic mismatch position relative to mutations in the target sequence. (A) Sequences for evaluation of the ideal synthetic mismatch position to detect a mutation between ssRNA 1 and ssRNA 2. On each of the targets, crRNAs with synthetic mismatches at the colored (red) locations are tested. Each set of synthetic mismatch crRNAs is designed such that the mutation location is shifted in position relative to the sequence of the spacer. Spacers are designed such that the mutation is evaluated at positions 3, 4, 5, and 6 within the spacer. Shown are SEQ ID NO:305-336. (B) Collateral cleavage activity on ssRNA 1 and 2 for crRNAs with synthetic mismatches at varying positions. There are four sets of crRNAs with the mutation at either position 3, 4, 5, or 6 within the spacer: target duplex region (n=4 technical replicates; bars represent mean±s.e.m.). (C) Specificity ratios of crRNA tested in (B). Specificity ratios are calculated as the ratio of the on-target RNA (ssRNA 1) collateral cleavage to the off-target RNA (ssRNA 2) collateral cleavage (n=4 technical replicates; bars represent mean±s.e.m.).

Figure 59:
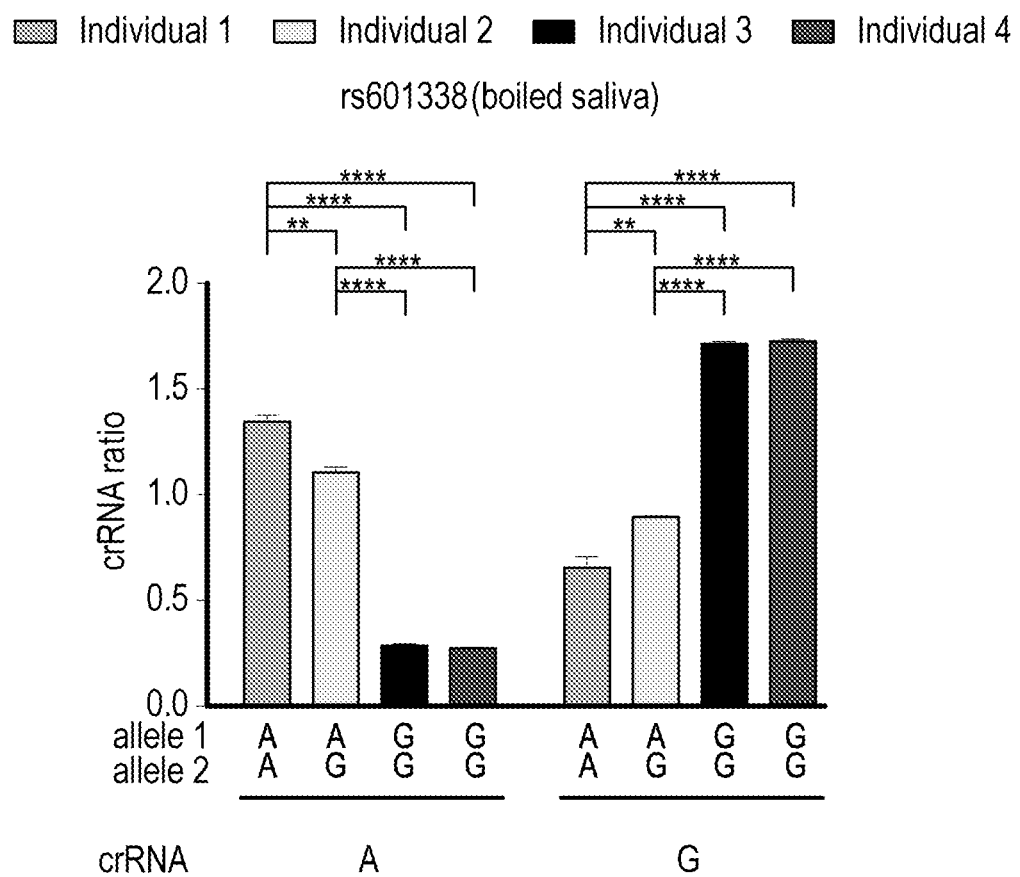

FIG. 59—Genotyping with SHERLOCK at an additional locus and direct genotyping from boiled saliva. SHERLOCK can distinguish between genotypes at the rs601338 SNP site in genomic DNA directly from centrifuged, denatured, and boiled saliva (n=4 technical replicates, two-tailed Student t-test; , $p<0.01$; **, $p<0.001$; bars represent mean±s.e.m.).

Figure 60:
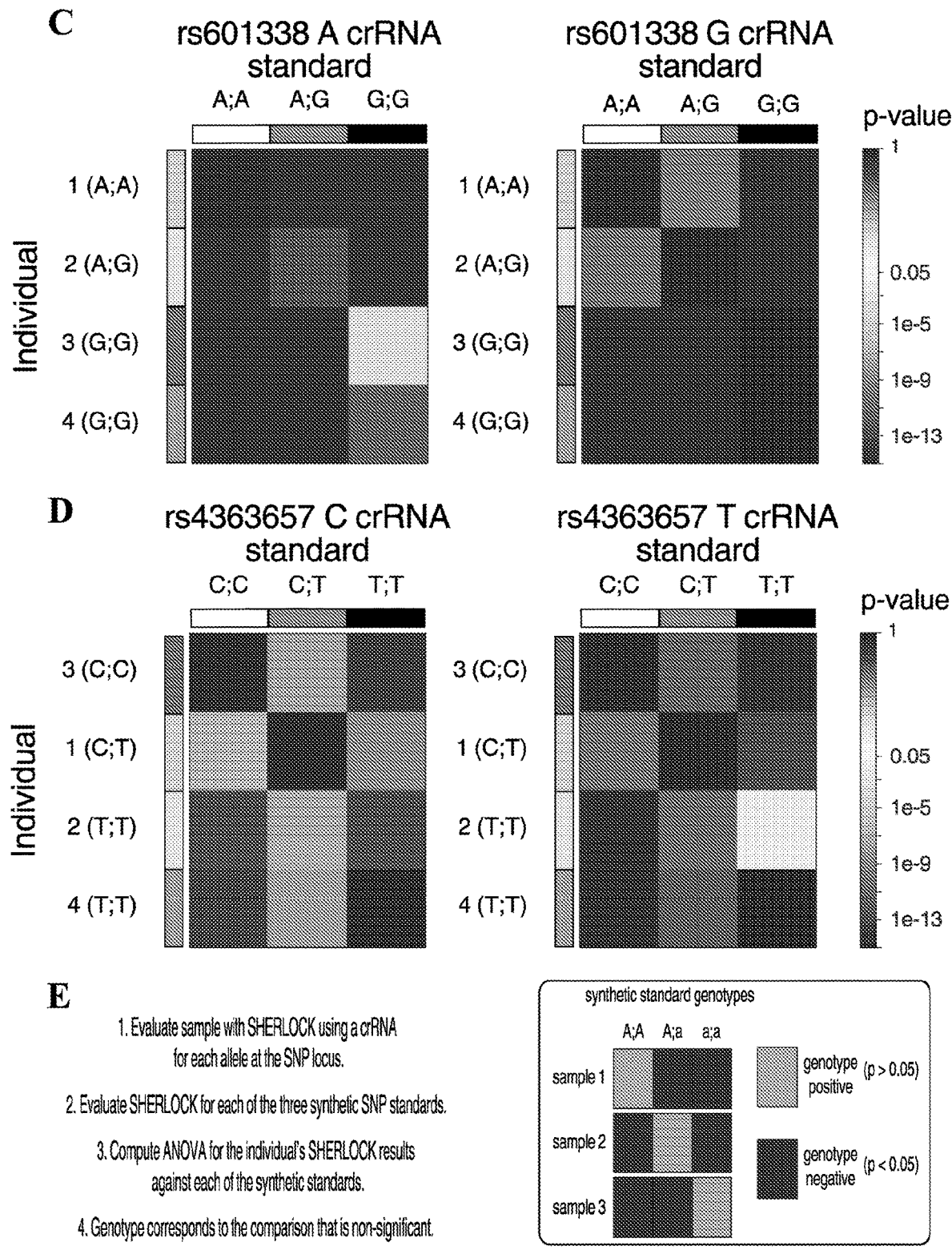

FIG. 60—Development of synthetic genotyping standards to accurately genotype human SNPs. (A) Genotyping with SHERLOCK at the rs601338 SNP site for each of the four individuals compared against PCR-amplified genotype standards (n=4 technical replicates; bars represent mean±s.e.m.). (B) Genotyping with SHERLOCK at the rs4363657 SNP site for each of the four individuals compared against PCR-amplified genotype standards (n=4 technical replicates; bars represent mean±s.e.m.). (C) Heatmaps of computed p-values between the SHERLOCK results for each individual and the synthetic standards at the rs601338 SNP site. A heatmap is shown for each of the allele-sensing crRNAs. The heatmap color map is scaled such that insignificance ($p>0.05$) is red and significance ($p<0.05$) is blue (n=4 technical replicates, one-way ANOVA). (D) Heatmaps of computed p-values between the SHERLOCK results for each individual and the synthetic standards at the rs4363657 SNP site. A heatmap is shown for each of the allele-sensing crRNAs. The heatmap color map is scaled such that insignificance ($p>0.05$) is red and significance ($p<0.05$) is blue (n=4 technical replicates, one-way ANOVA). (E) A guide for understanding the p-value heatmap results of SHERLOCK genotyping. Genotyping can easily be called by choosing the allele that corresponds to a p-value $>0.05$ between the individual and allelic synthetic standards. Red blocks correspond to non-significant differences between the synthetic standard and individual's SHERLOCK result and thus a genotype-positive result. Blue blocks correspond to significant differences between the synthetic standard and individual's SHERLOCK result and thus a genotype-negative result.

Figure 61:
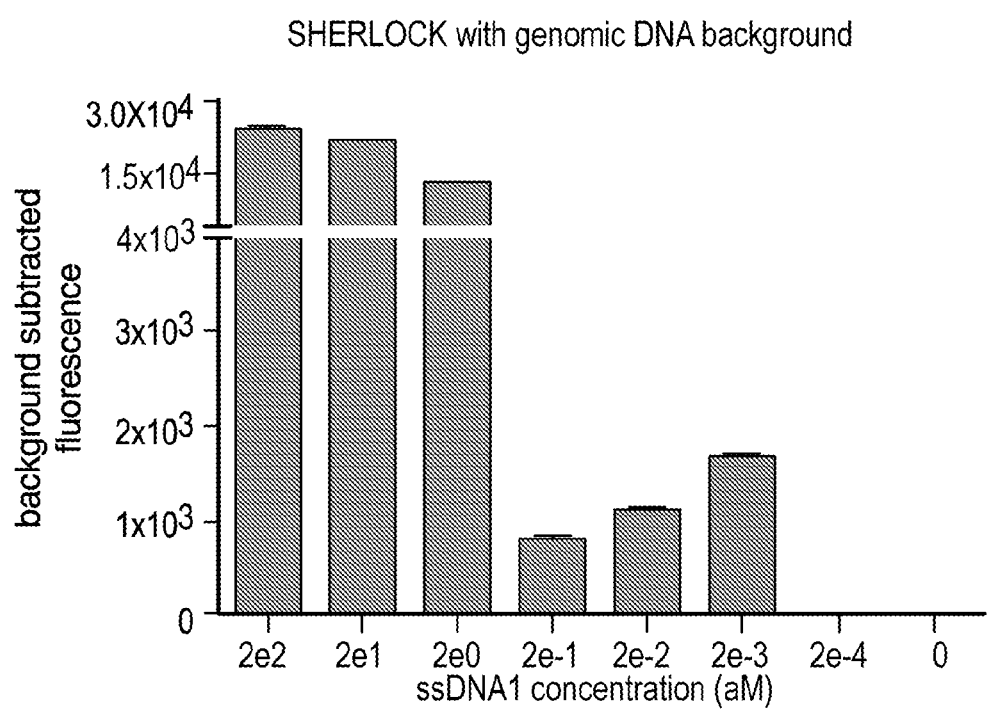

FIG. 61—Detection of ssDNA 1 as a small fraction of mismatched background target. SHERLOCK detection of a dilution series of ssDNA 1 on a background of human genomic DNA. Note that there should be no sequence similarity between the ssDNA 1 target being detected and the background genomic DNA (n=2 technical replicates; bars represent mean±s.e.m.).

Figure 62A:
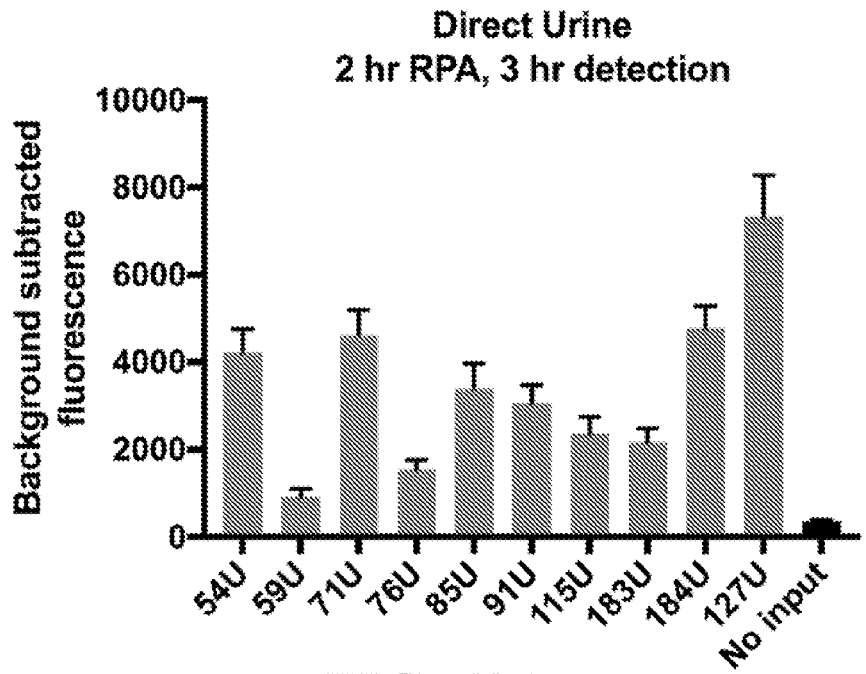
Figure 62B:
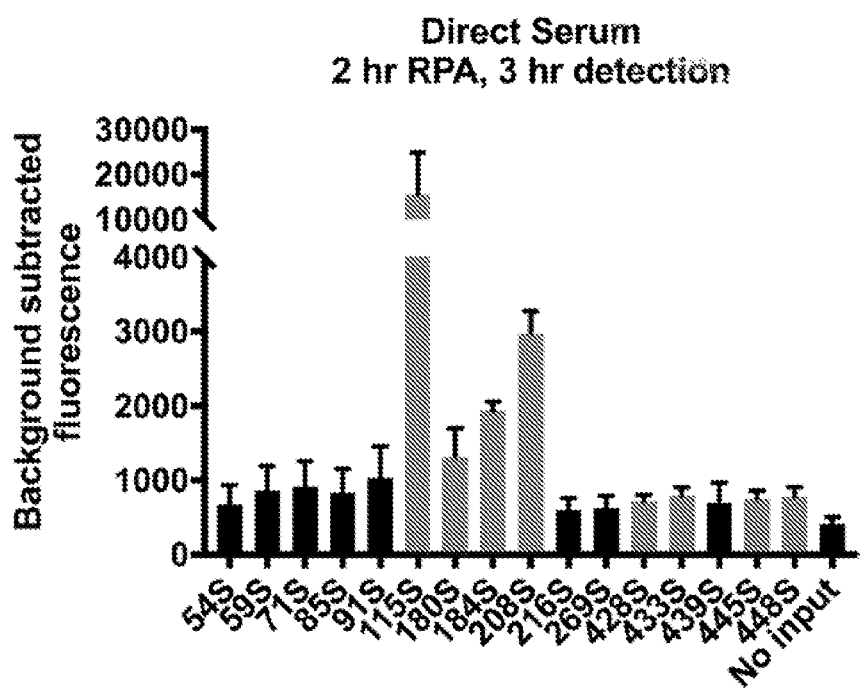

FIG. 62—Urine (A) or serum (B) samples from patients with Zika virus were heat inactivated for 5 minutes at 95° C. (urine) or 65° C. (serum). One microliter of inactivated urine or serum was used as input for a 2 hr RPA reaction followed by a 3 hour C2c2/Cas13a detection reaction, in accordance with an example embodiment. Error bards indicate 1 SD based on n=4 technical replicates for the detection reaction.

Figure 63A:
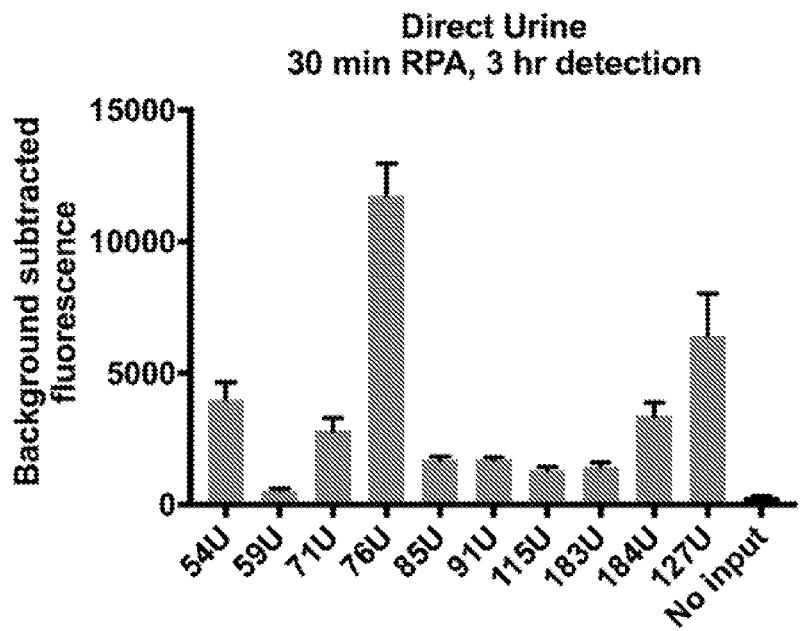
Figure 63B:
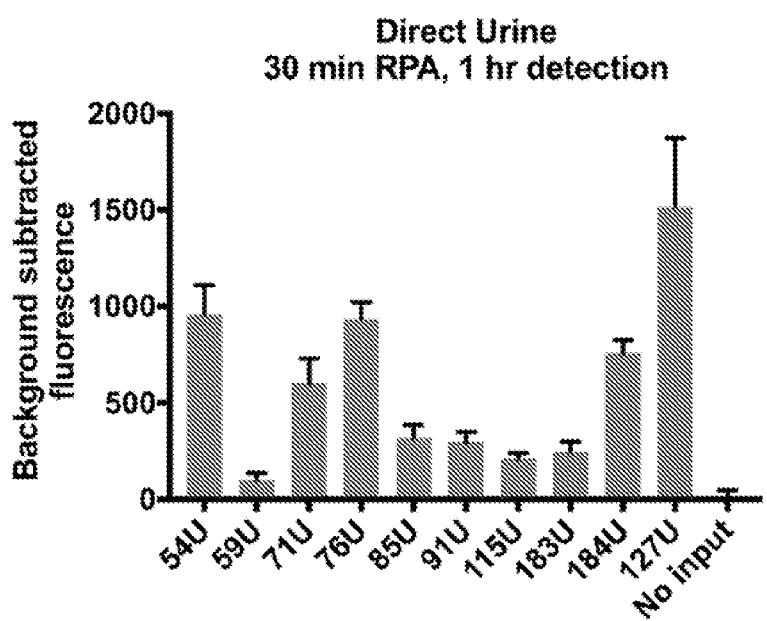

FIG. 63—Urine samples from patients with Zika virus were heat-inactivated for 5 minutes at 95° C. One microliter of inactivated urine was used as input for a 30 minute RPA reaction followed by a 3 hour (A) or 1 hour (B) C2c2/Cas13 detection reaction, in accordance with example embodiments. Error bars indicate 1 SD based on n=4 technical replicates for the detection reaction.

Figure 64:
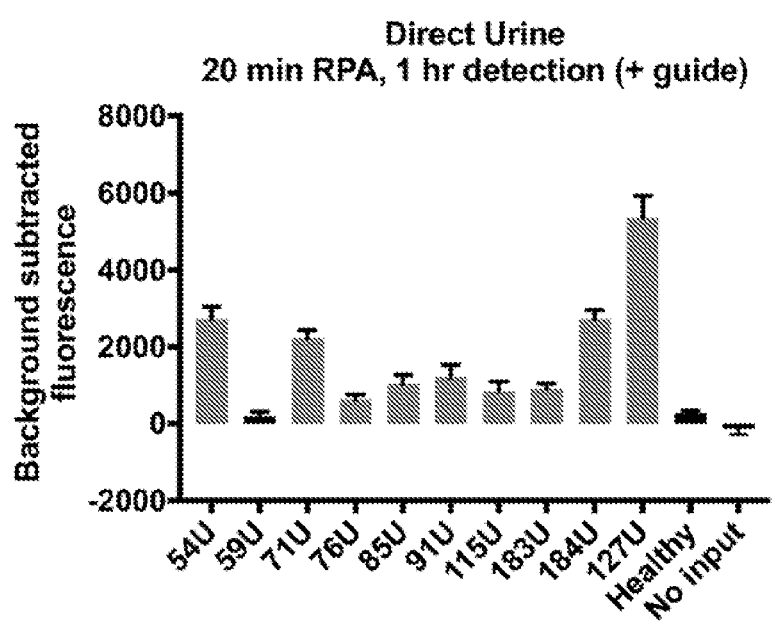

FIG. 64—Urine samples form patients with Zika virus were heat-inactivated for 5 minutes at 95° C. One microliter of inactivated urine was used as input for a 20 minute RPA reaction followed by a 1 hour C2c2/Cas13a detection reaction. Healthy human urine was used as a negative control. Error bars indicate 1 SD based on n=4 technical replicates or the detection reaction.

Figure 65A:
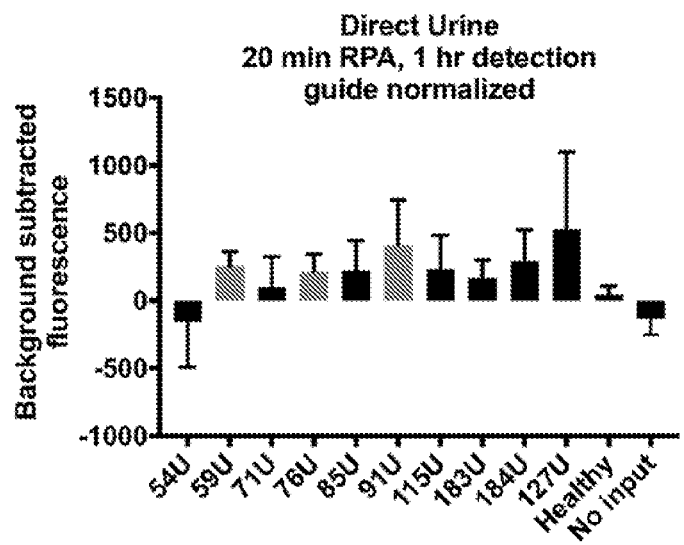
Figure 65B:
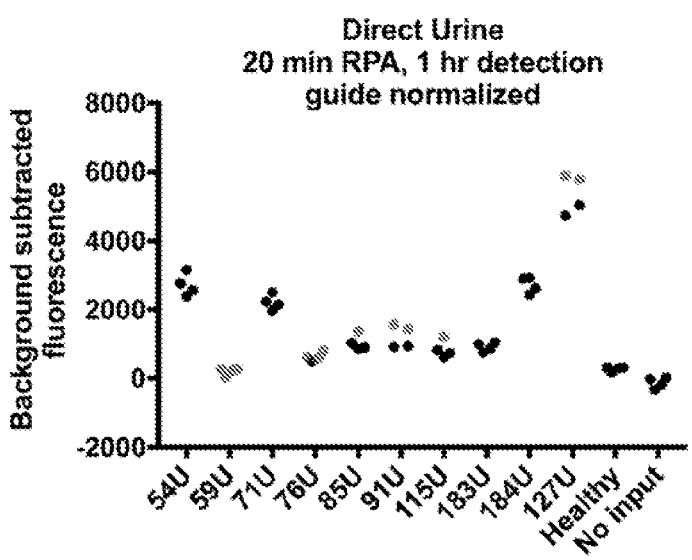

FIG. 65—Urine samples from patients with Zika virus were heat-inactivated for 5 minutes at 95° C. One microliter of inactivated urine was used as input for a 20 minute RPA reaction followed by a 1 hour C2c2/Cas13a detection reaction in the presence or absence of guide RNA. Data are normalized by substracting the average fluorescence values for no-guide detection reactions from the detection reactions containing guides. Healthy human urine was used as a negative control. Error bars indicate 1 SD based on n=4 technical replicates for the detection reaction.

Figure 66:
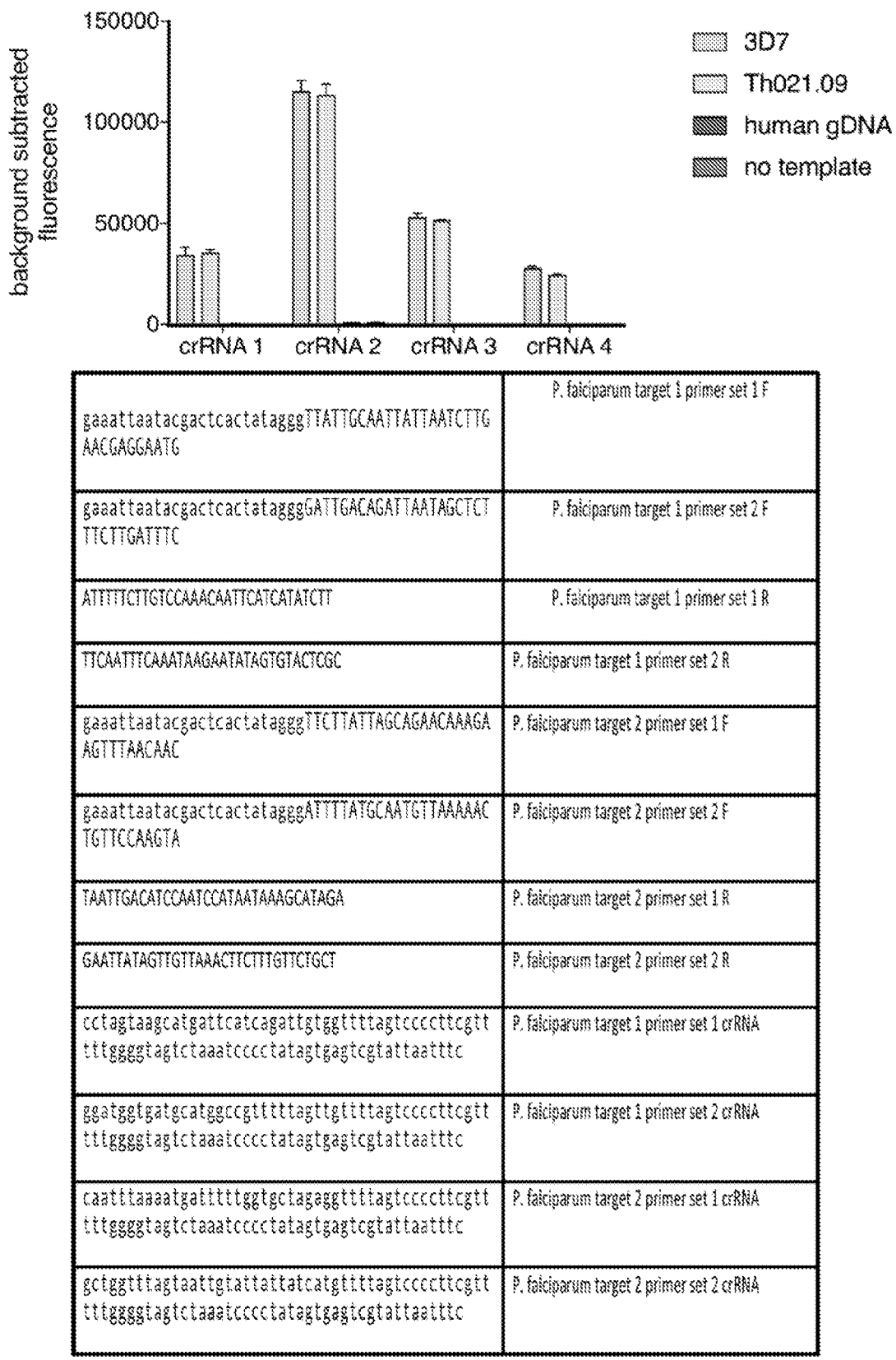

FIG. 66—Shows detection of two malaria specific targets with four different guide RNA designs, in accordance with example embodiments. Shown are SEQ ID NO:337-348.

Figure 67:
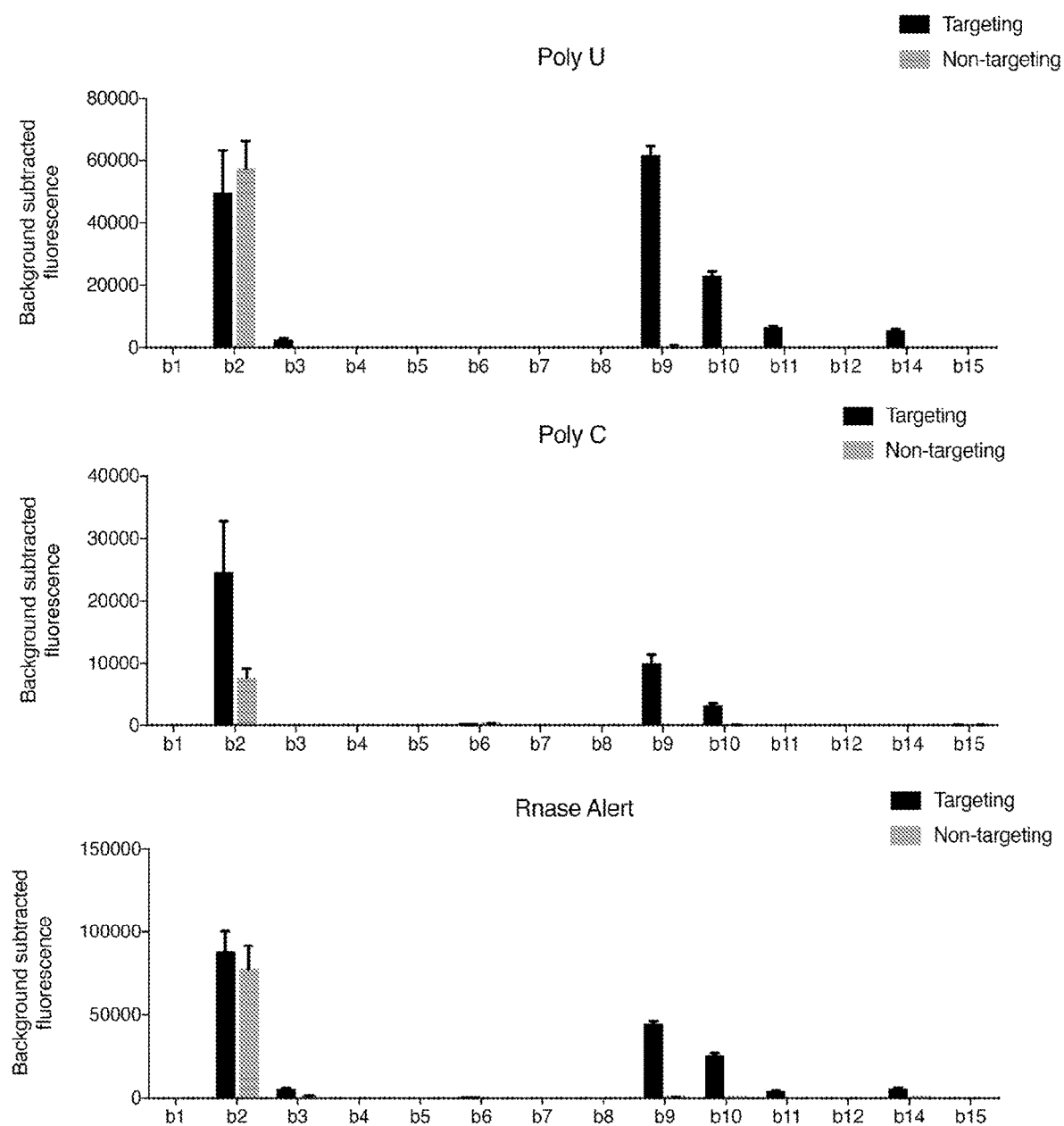
Figure 67:
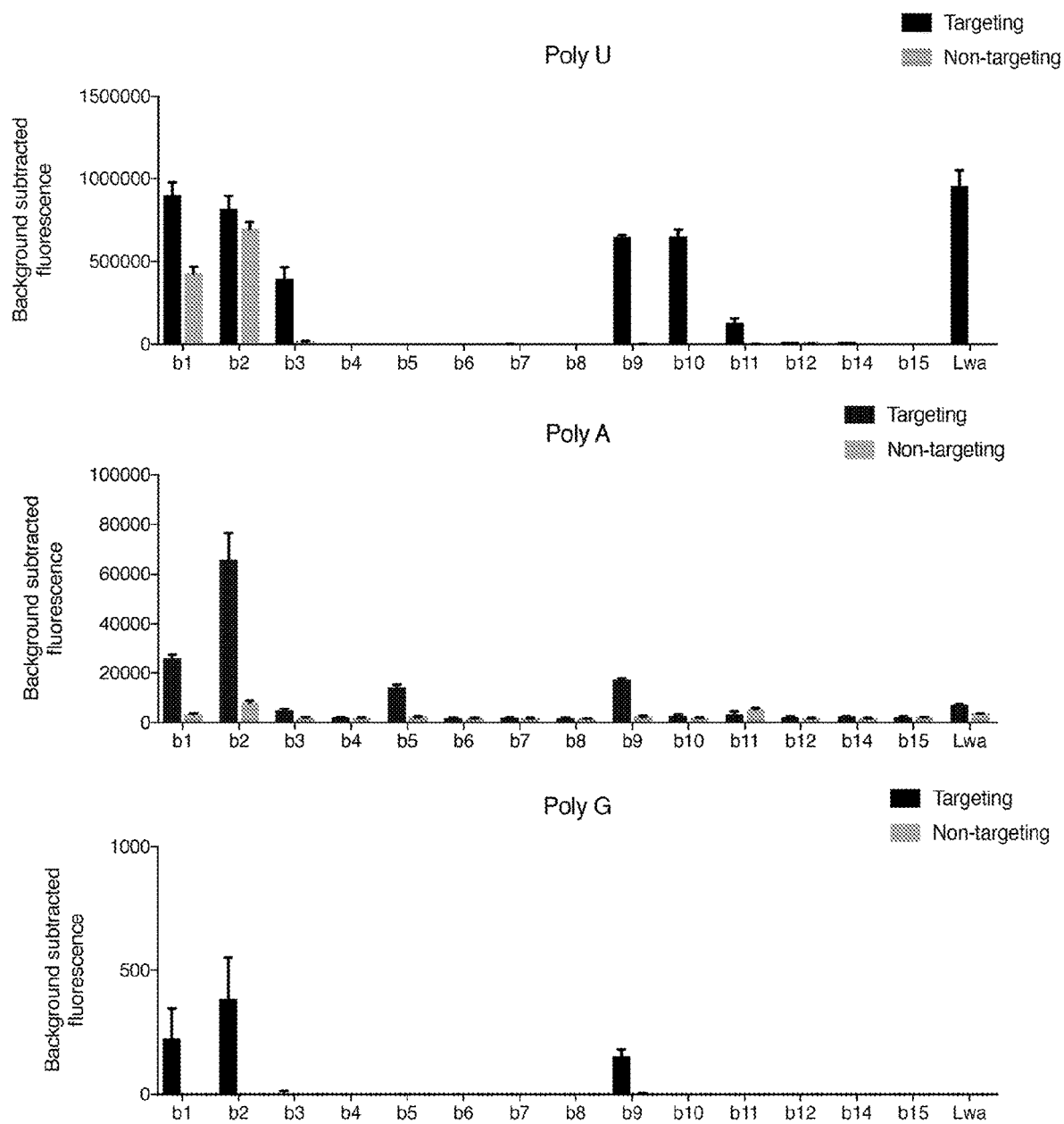

FIG. 67—Provides graphing showing editing preferences of different Cas13b orthologs. See Table 3 for key.

Figure 68:
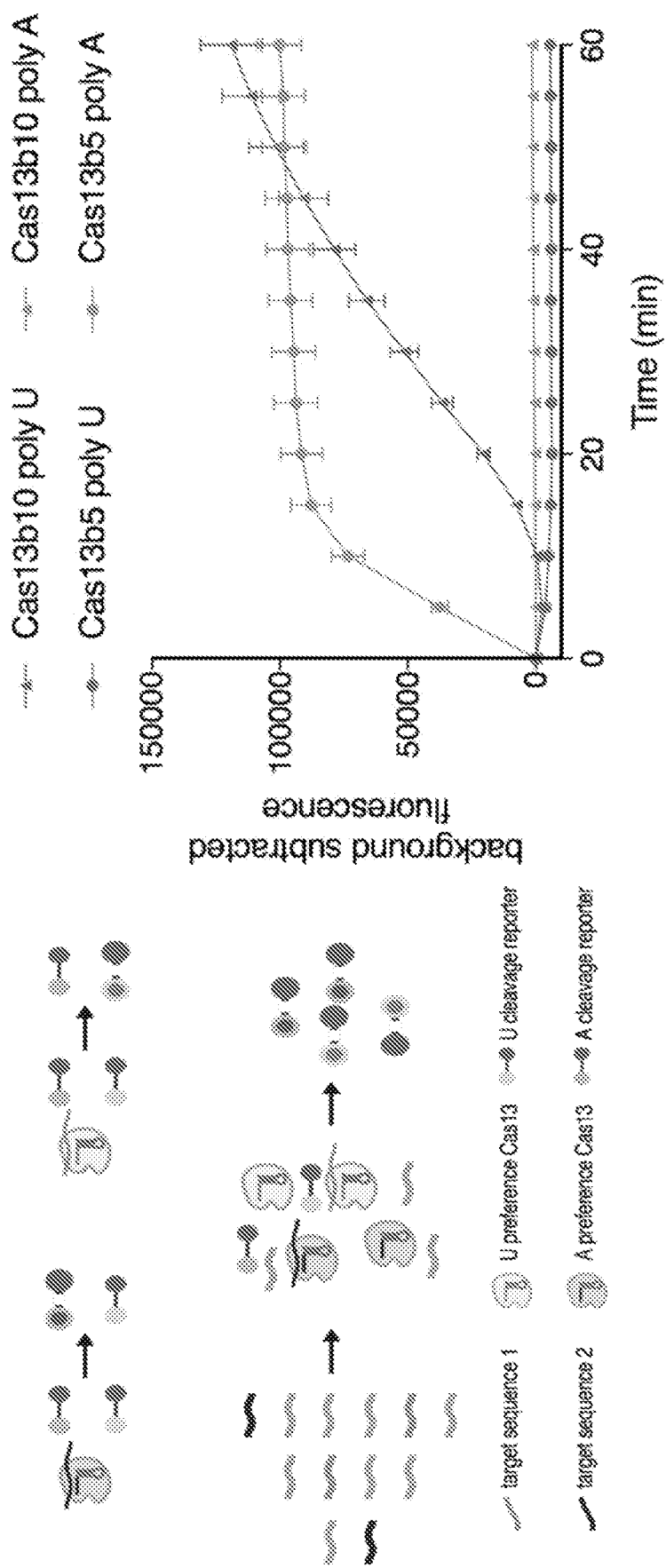

FIG. 68—provides A) a schematic of a multiplex assay using different Cas13b orthologs with different editing preferences, and B) data demonstrating the feasibility of such an assay using Cas13b10 and Cas13b5.

Figure 69:
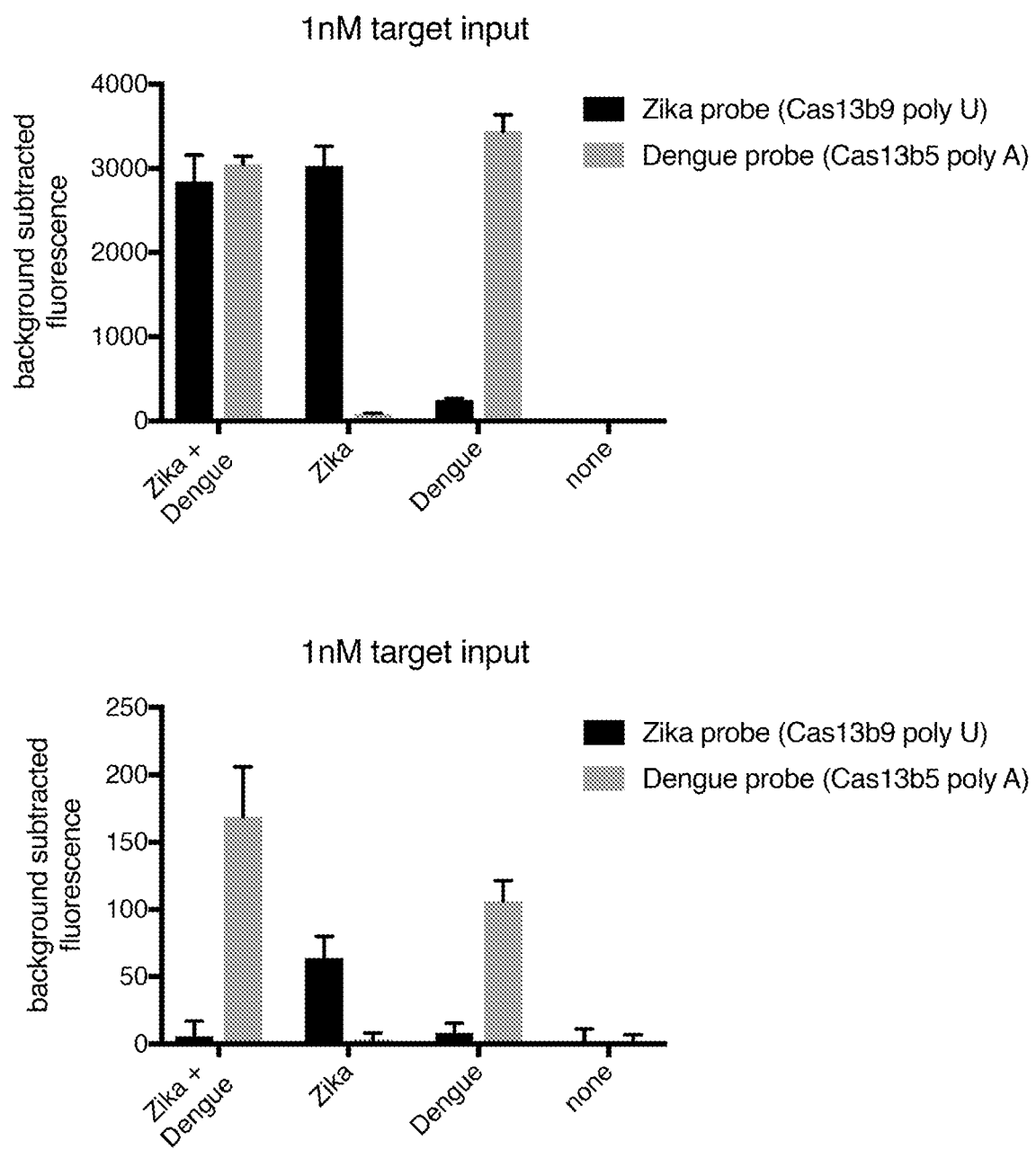

FIG. 69—provides graphs showing dual multiplexing with Cas13b5 (*Prevotella* sp. MA2106) and Cas13b9 (*Prevotella intermedia*) orthologues. Both effector proteins and guide sequences were contained in the same reaction allowing for dual multiplexing in the same reaction using different fluorescent readouts (poly U 530 nm and poly A 485 nm).

Figure 70:
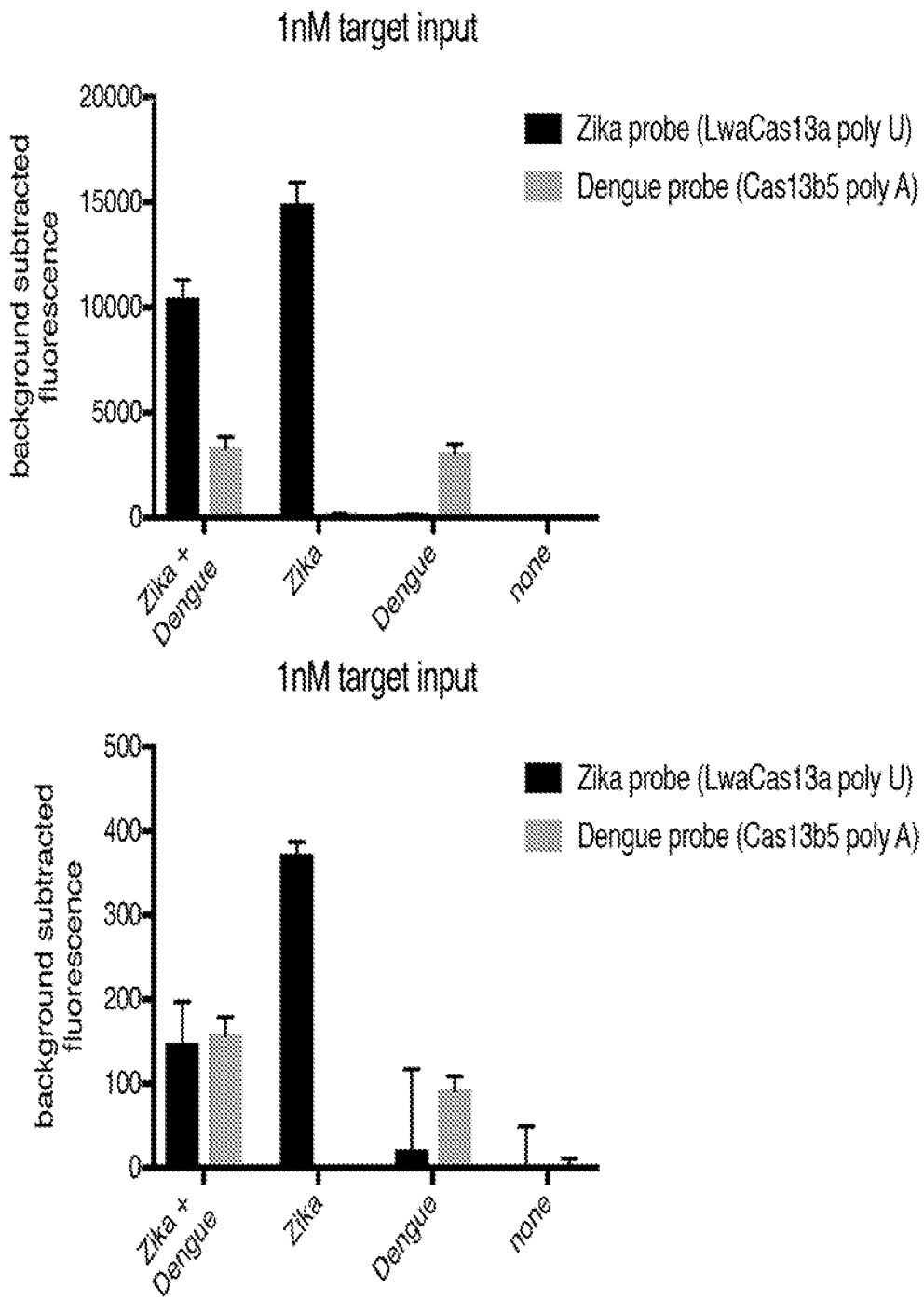

FIG. 70—provides same as FIG. 69 but in this instance using a Cas13a (*Leptorichia wadei* LwaCas13a) orthologs and Cas13b orthologs (*Prevotella* sp. MA2016, Cas13b5).

Figure 71:
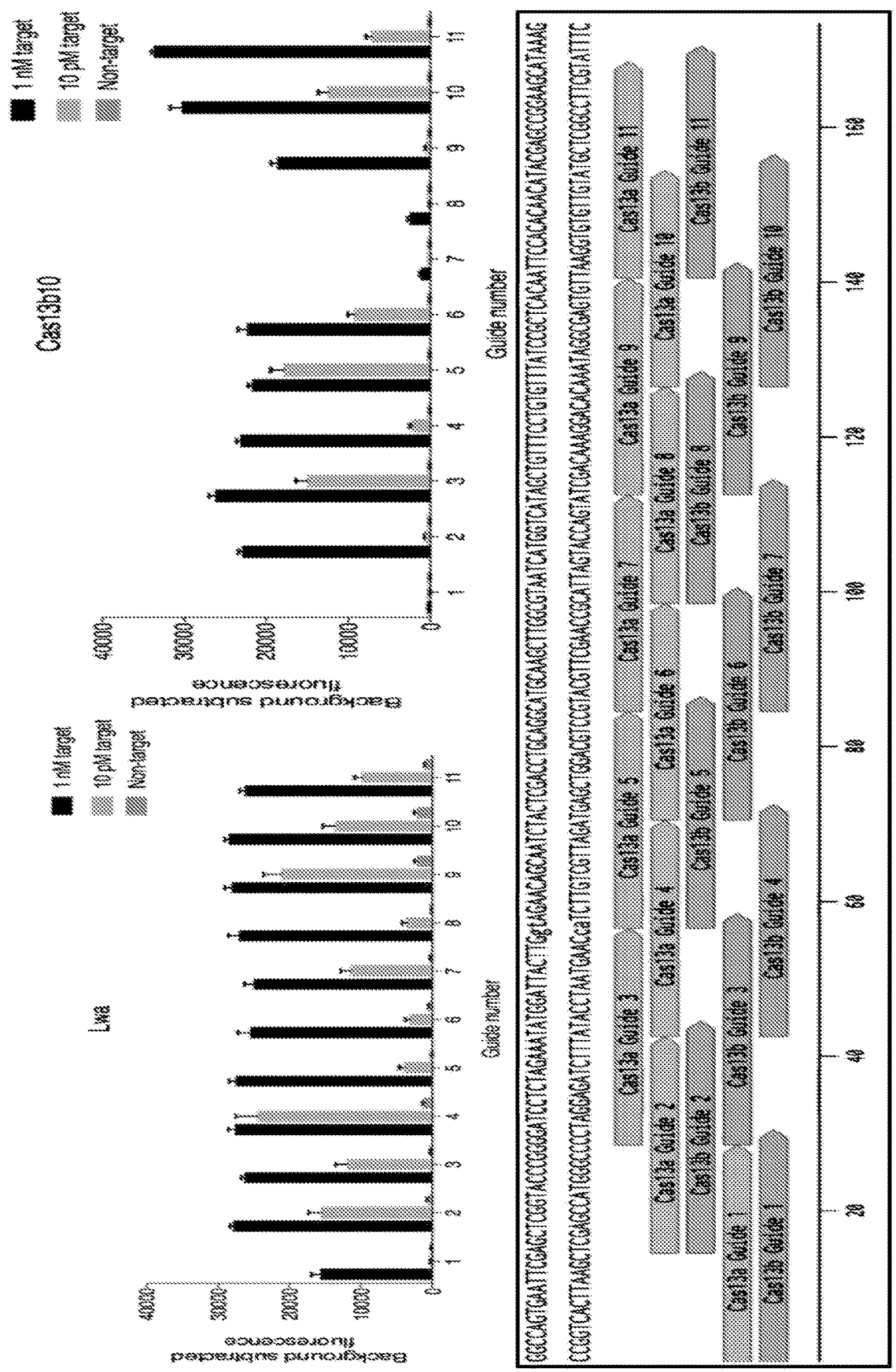

FIG. 71—provides a method for tiling target sequences with multiple guide sequence in order to determine robustness of targeting, in accordance with certain example embodiments. Shown are SEQ ID NO:349 and 350.

Figure 72:
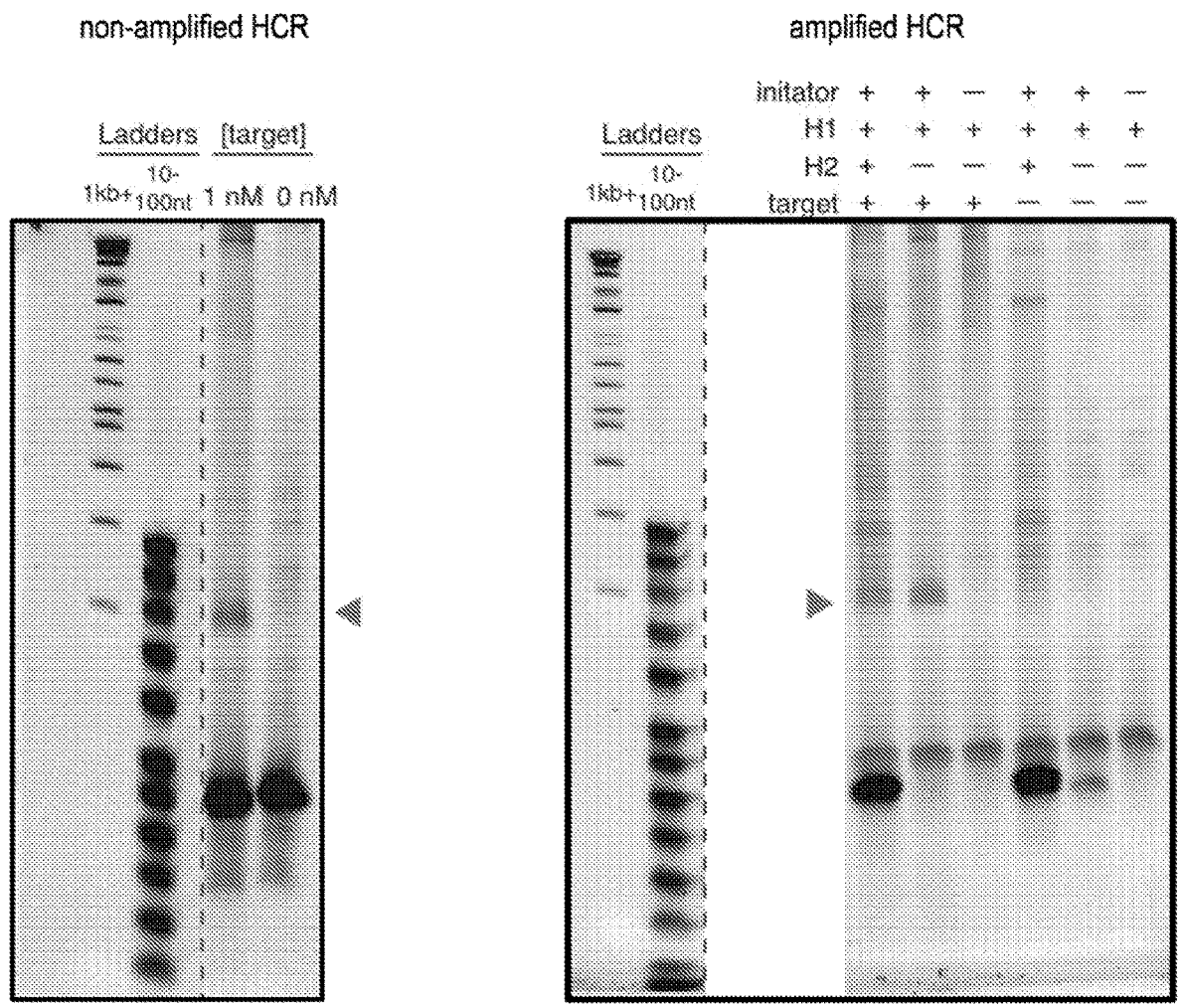

FIG. 72—provides hybrid chain reaction (HCR) gels showing that Cas13 effector proteins may be used to unlock an initiator, for an example an initiator incorporated in a masking construct as described herein, to activate a hybridization chain reaction.

Figure 73:
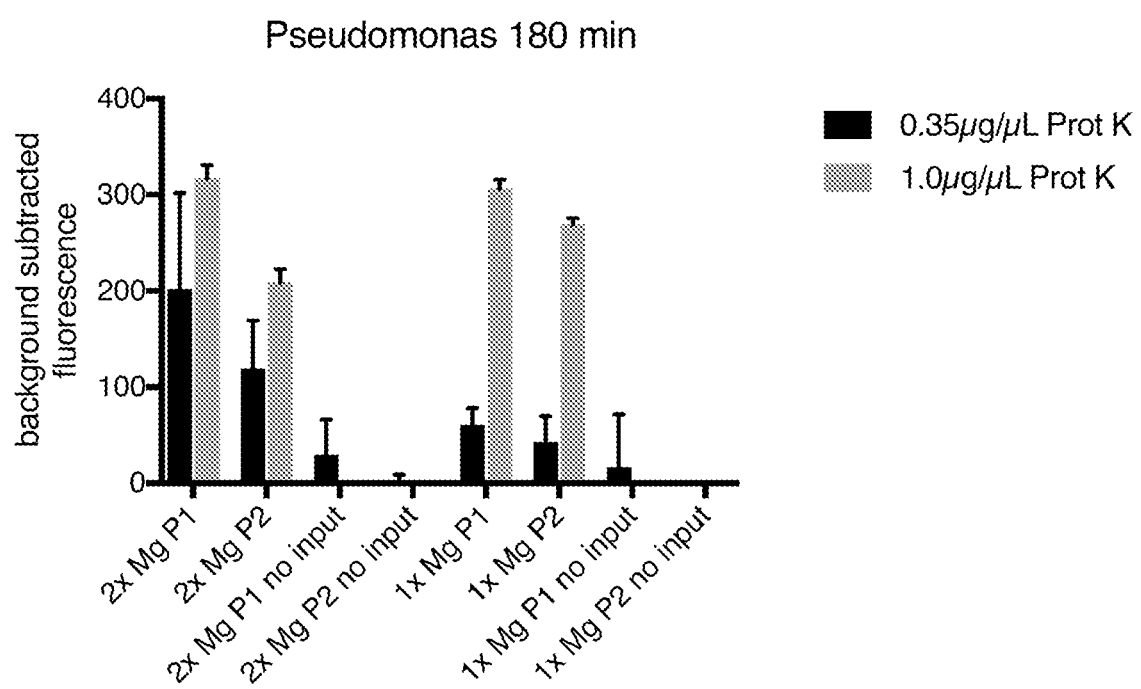

FIG. 73—provides data showing the ability to detect *Pseudomonas aeruginosa* in complex lysate.

Figure 74:
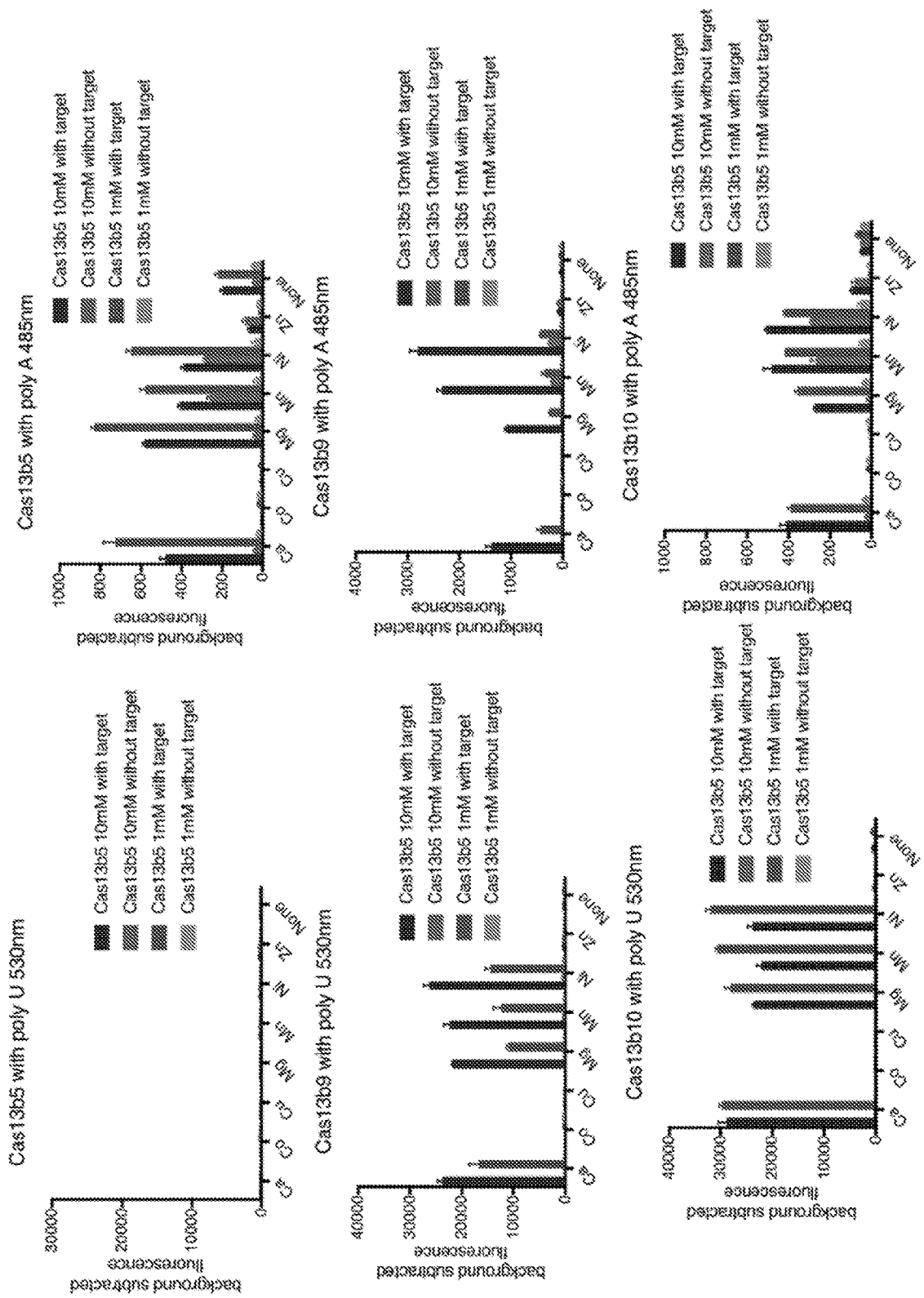

FIG. 74—provides data showing ion preferences of certain Cas13 orthologues in accordance with certain example embodiments. All target concentrations were 20 nM input with ion concentrations of (1 mM and 10 mM).

FIG. 75—provides data showing that Cas13b12 has a 1 mM Zinc sulfate preference for cleavage.

Figure 76:
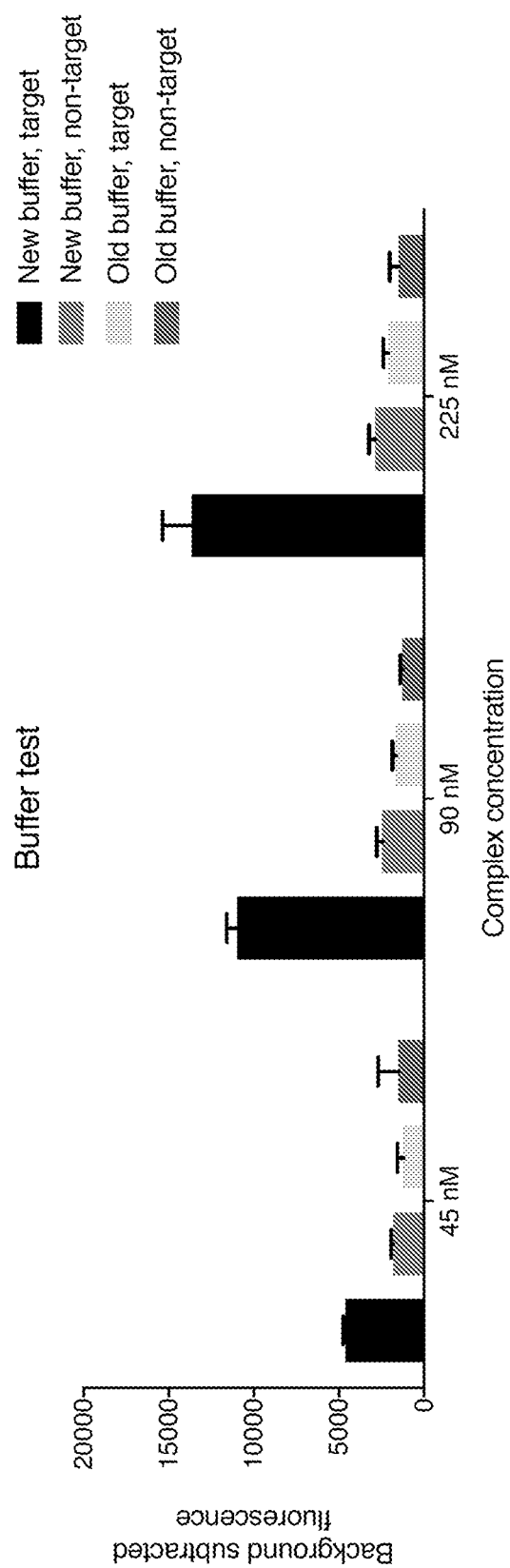

FIG. 76—provides data showing buffer optimization may boost signal to noice of Cas13b5 on a polyA reporter. Old buffer comprises 40 mM Tris-HCL, 60 mM NaCl, 6 mM MgCl2, pH 7.3. New buffer comprises 20 mM HEPES pH 6.8, 6 mM MgCl2 and 60 mM NaCl.

Figure 77:
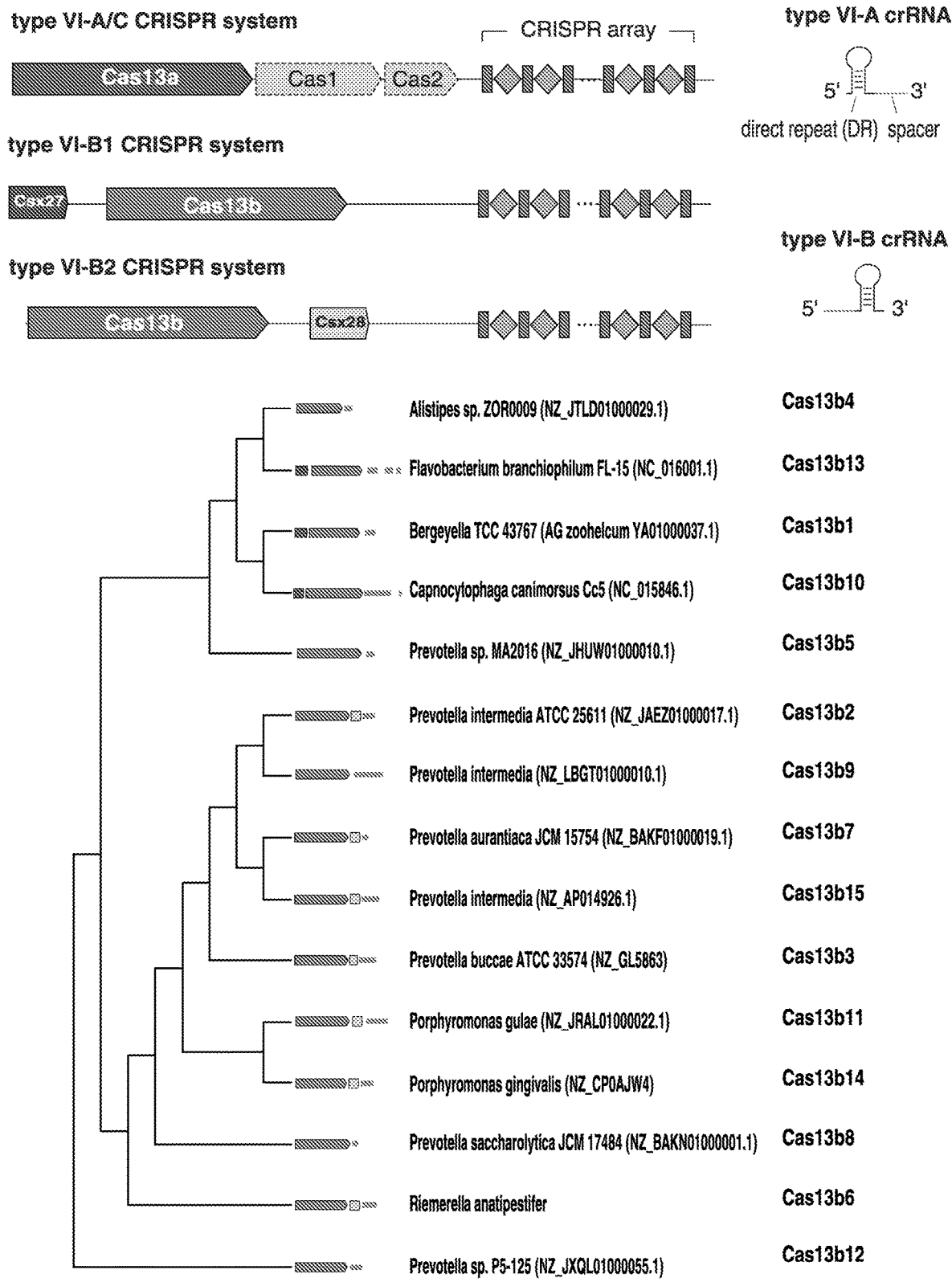

FIG. 77—provides a schematics of type VI-A/C Crispr systems and Type VI-B1 and B2 systems as well as a phylogenetic tree of representative Cas13b orthologues.

Figure 78:
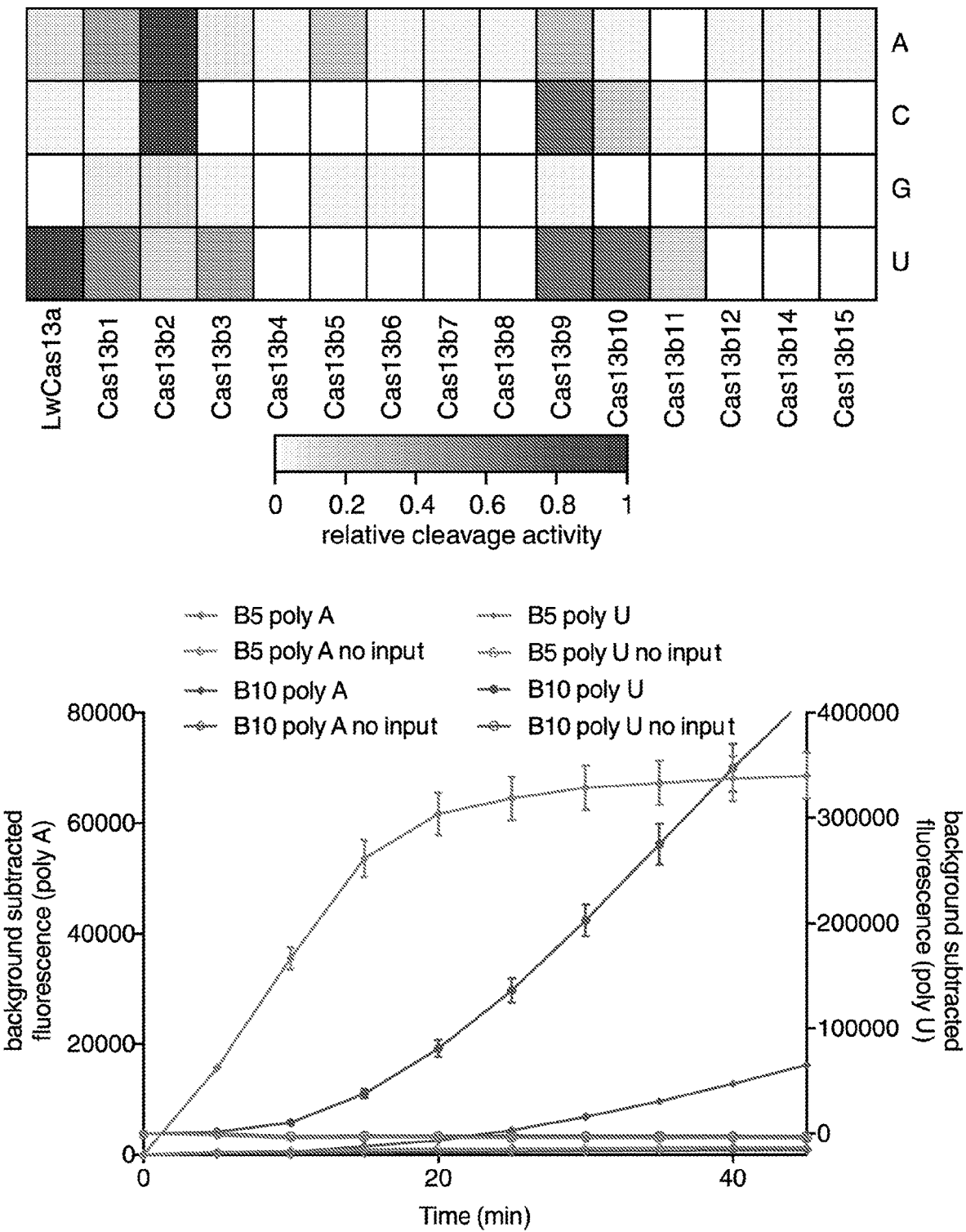

FIG. 78—provides relative cleavage activity at different nucleotides of various Cas13b orthologs and relative to a LwCas13a.

Figure 79:
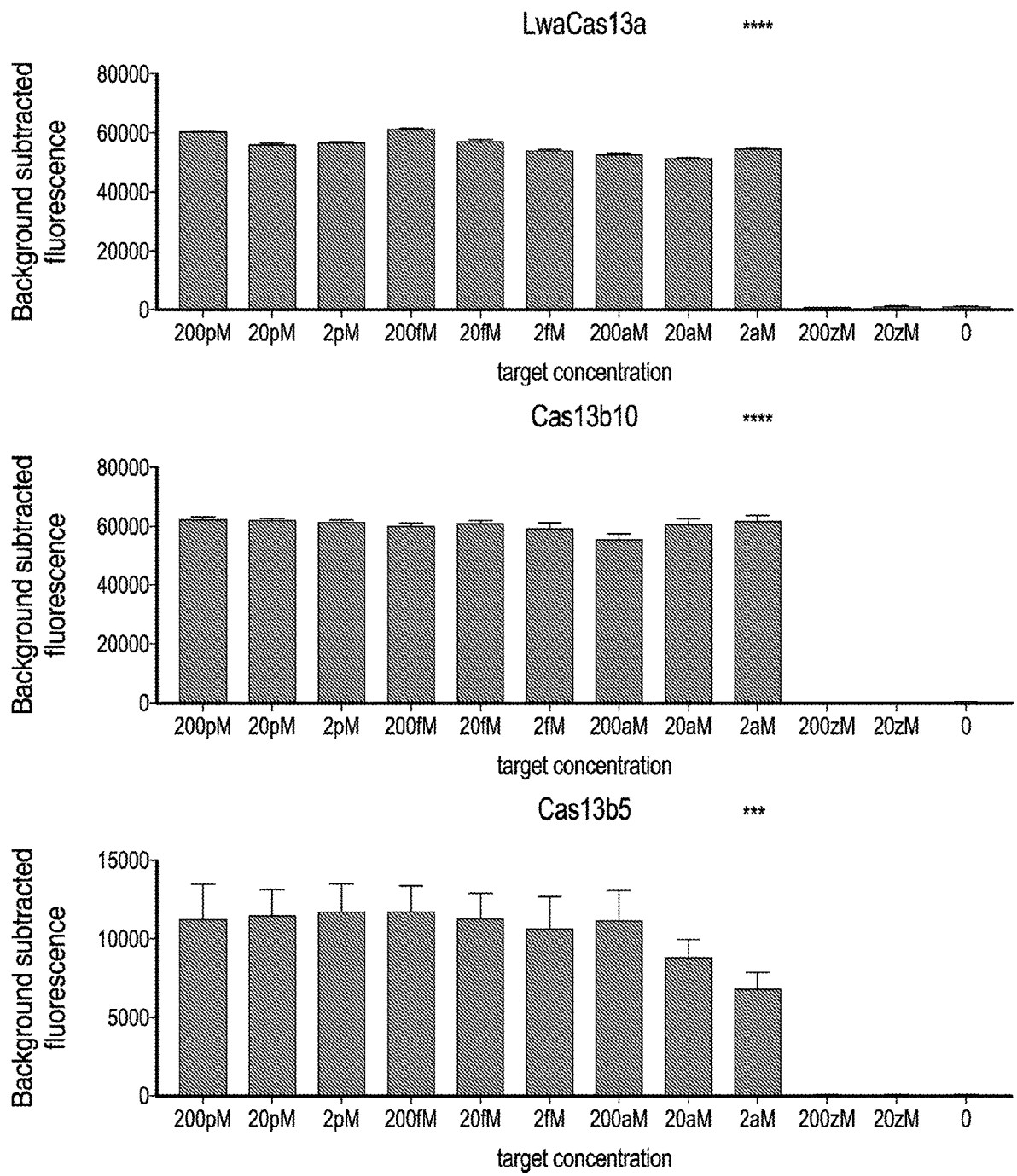

FIG. 79—provides a graph show relative sensitivity of various example Cas13 orthologs.

Figure 80:
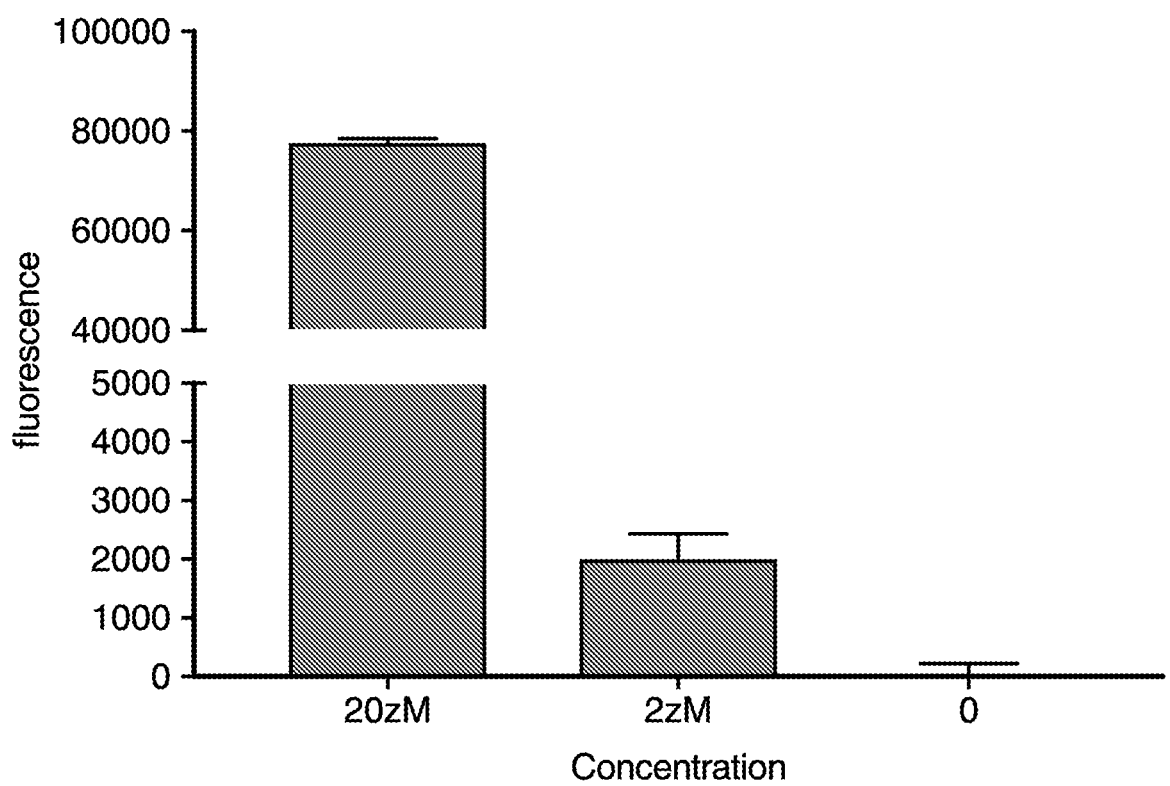

FIG. 80—provides graph showing the ability to achieve zepto molar (zM) levels of detection using an example embodiment.

Figure 81:
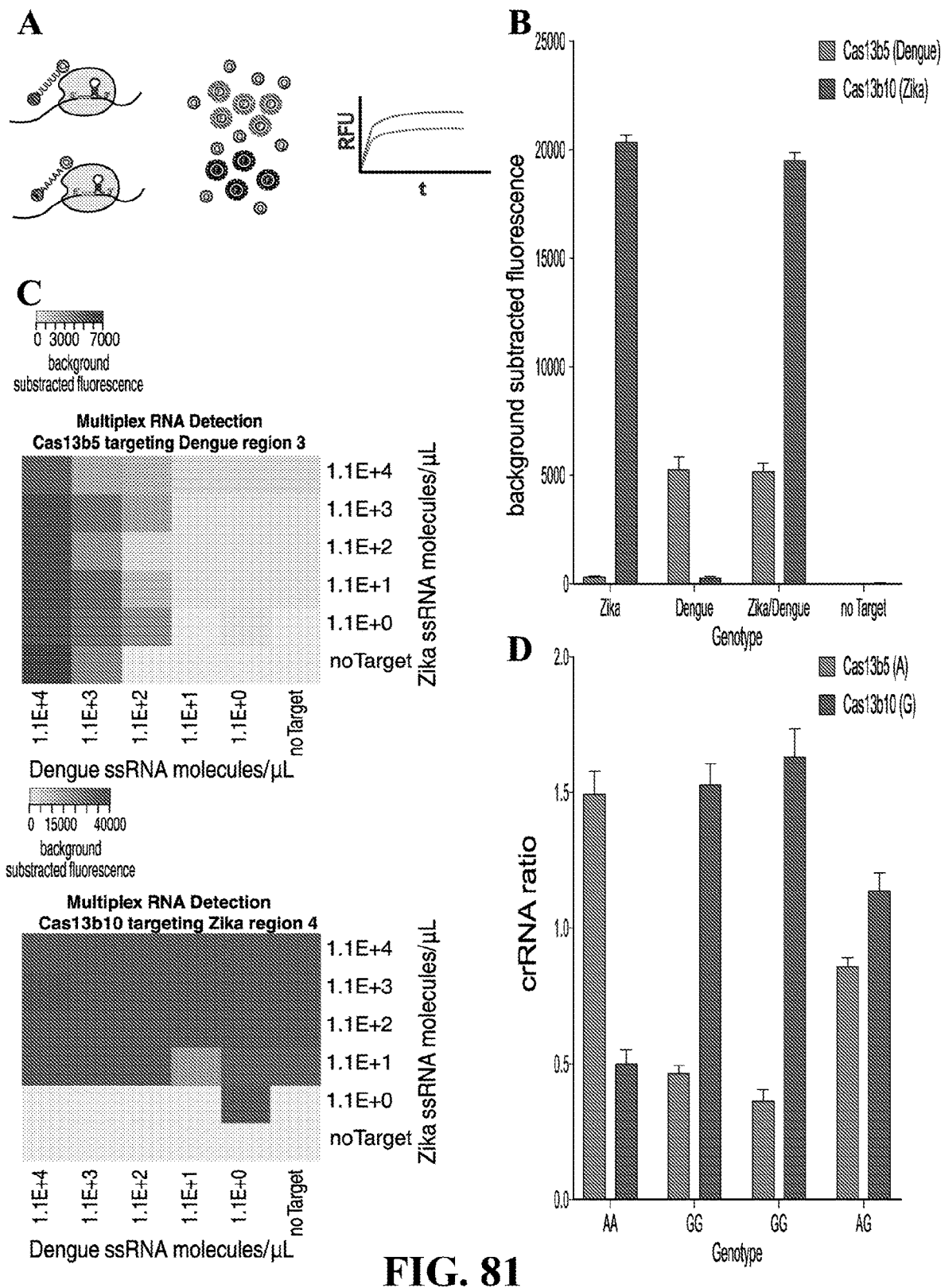

FIG. 81—provides schematic of a multiplex assay using Cas13 orthologs with different editing preferences and polyN based masking constructs.

Figure 82:
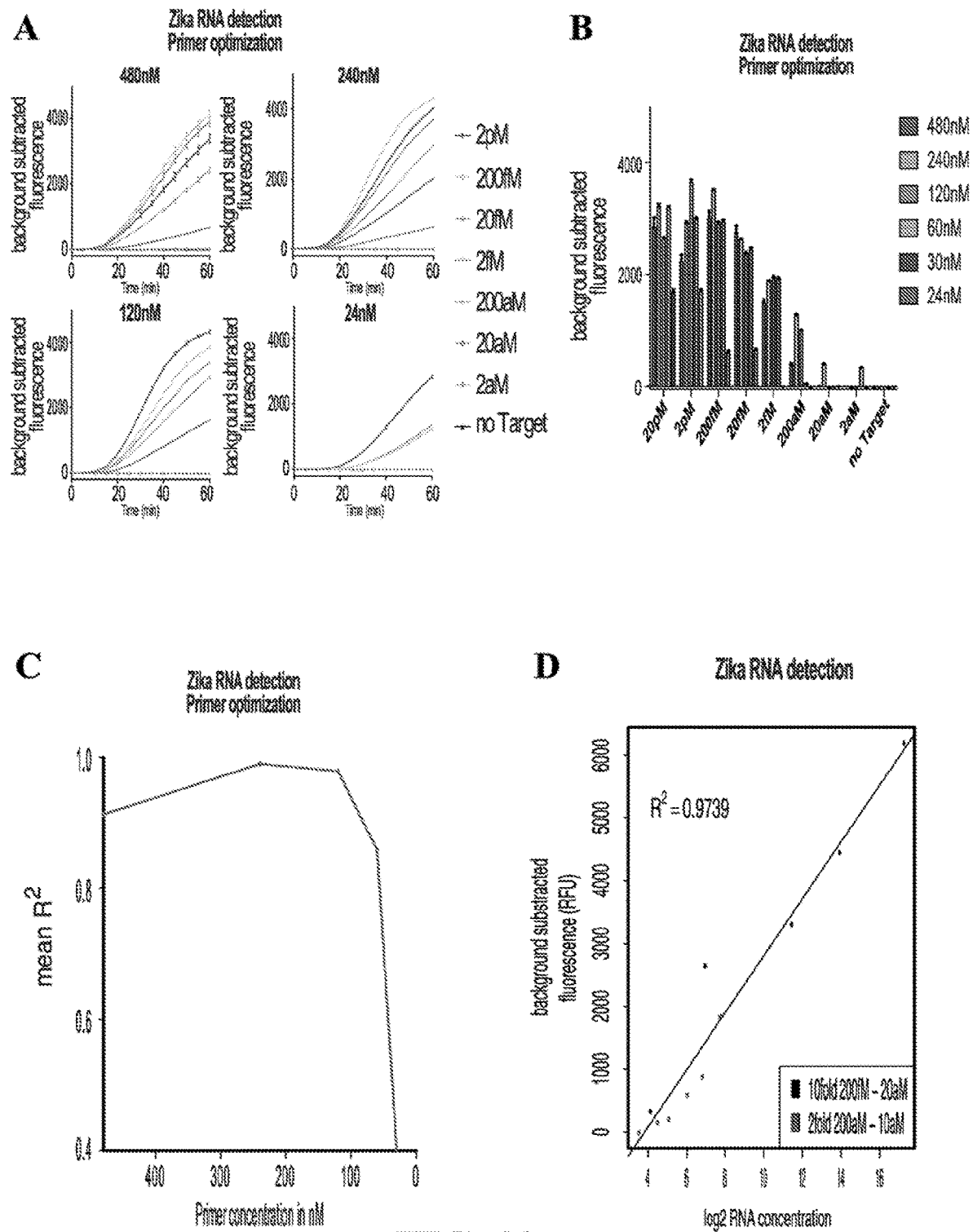

FIG. 82—provides data showing results of primer optimization experiments and detection of pseudomonas over a range of conditions.

Figure 83:
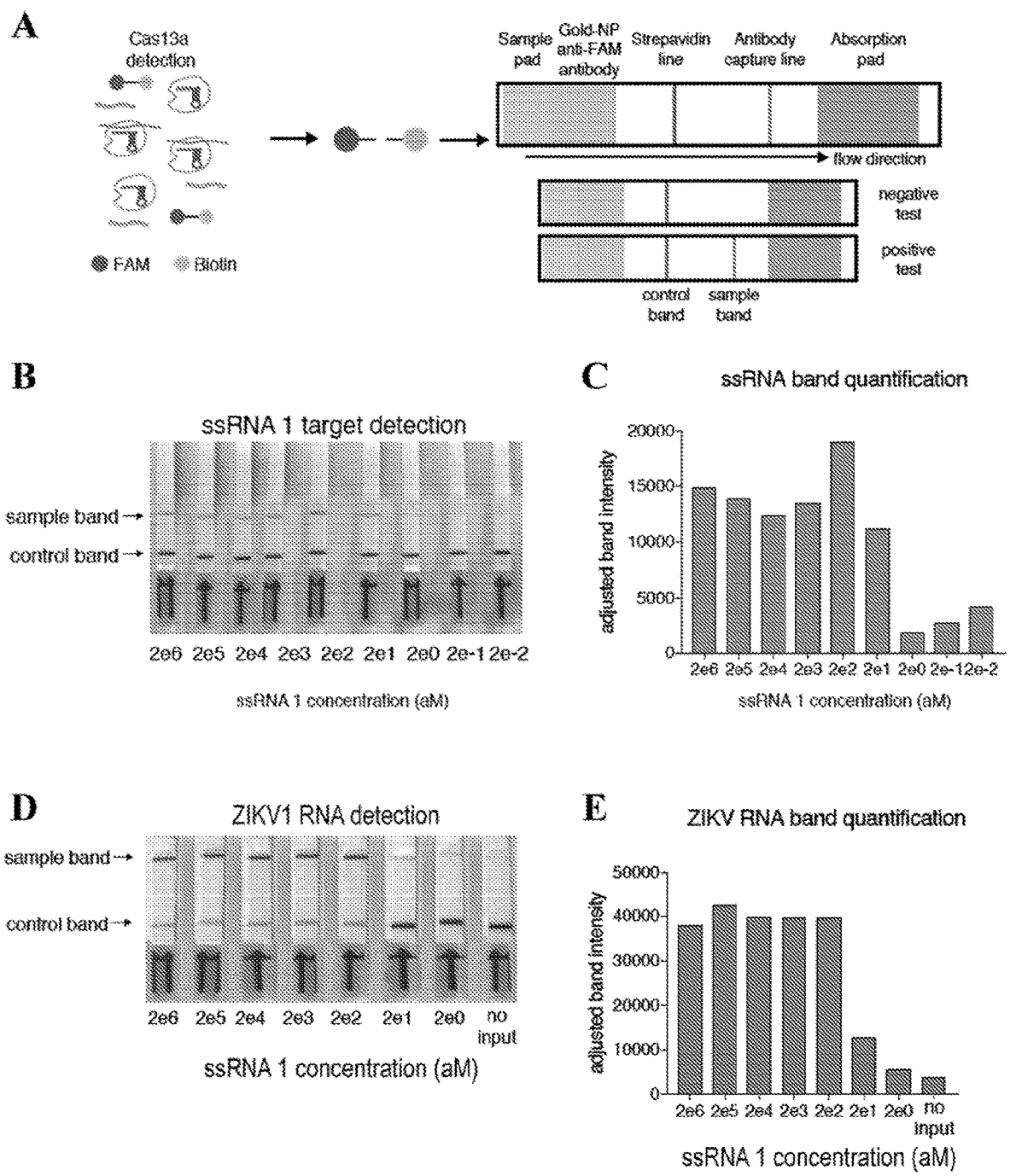

FIG. 83—provides a schematic of a lateral flow assay and results obtained using a lateral flow device in accordance with certain example embodiments.

Figure 84:
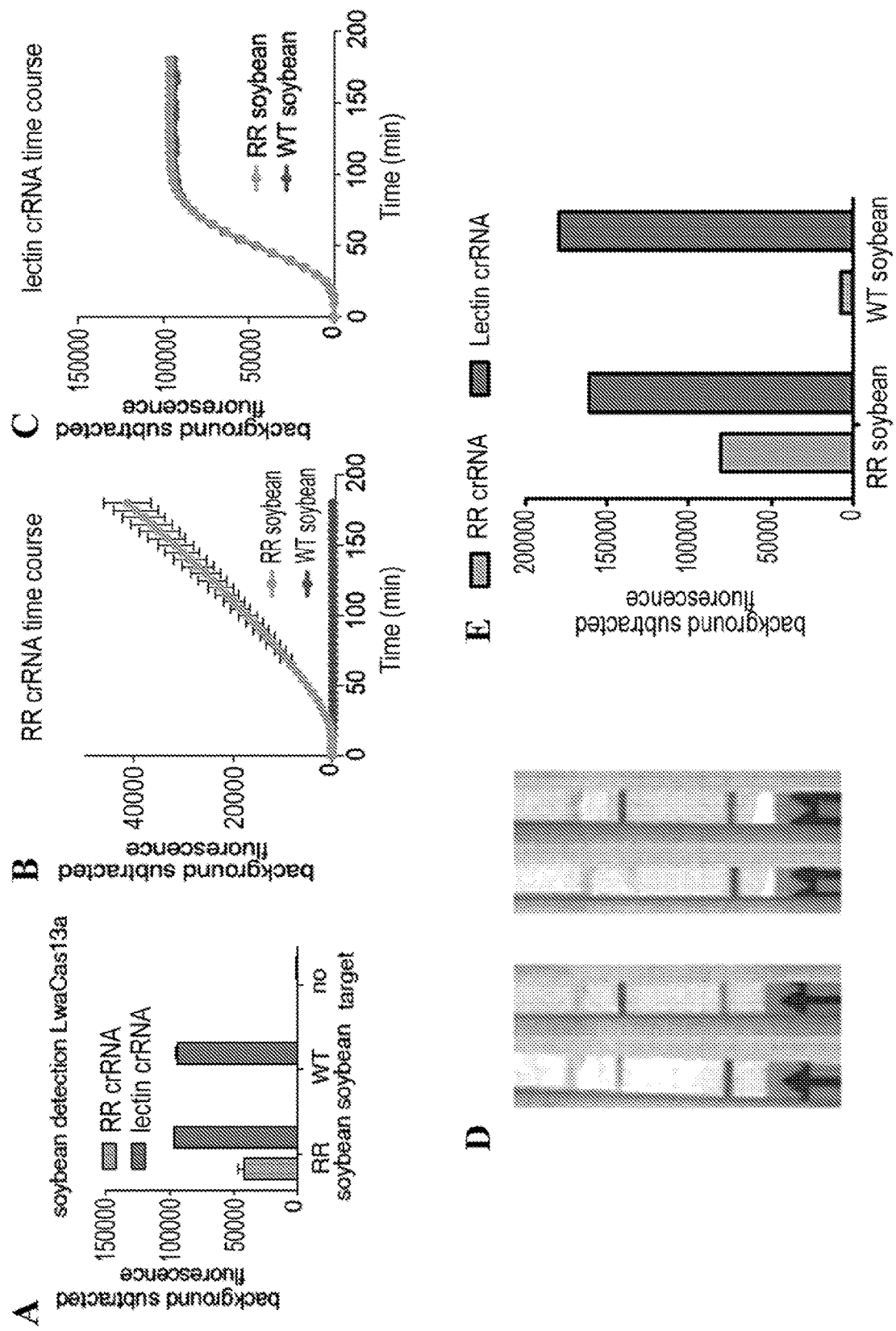

FIG. 84—provides ability to detect specific soybean stains using a lateral flow device in accordance with certain example embodiments.

Figure 85:
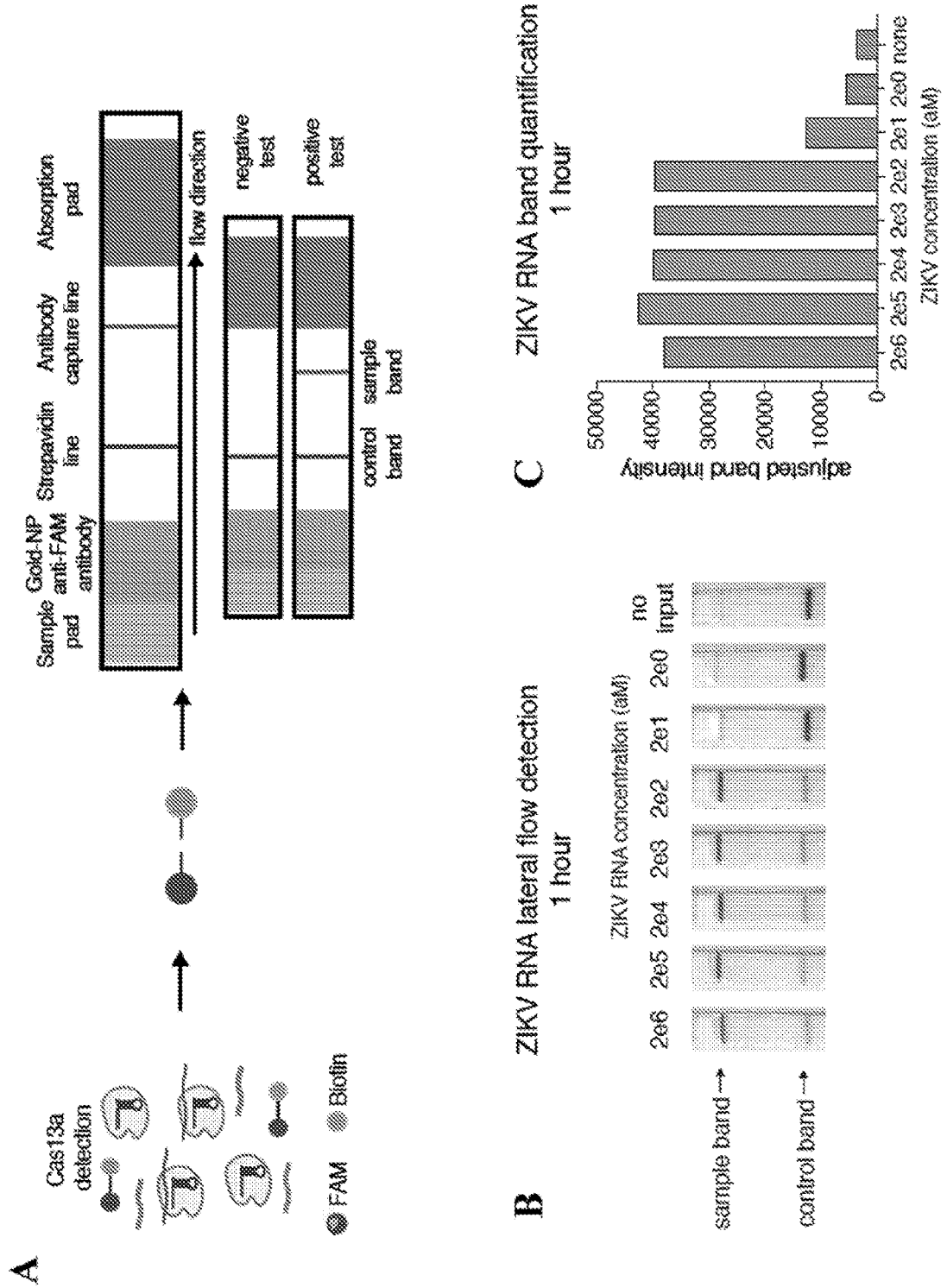

FIG. 85—Adapting SHERLOCK for lateral flow detection. (A) Schematic of lateral flow detection with SHERLOCK. (B) Detection of synthetic Zika RNA using lateral flow SHERLOCK with 1 hour of LwaCas13a reaction. (C) Quantitation of band intensity from detection in (B).

Figure 86:
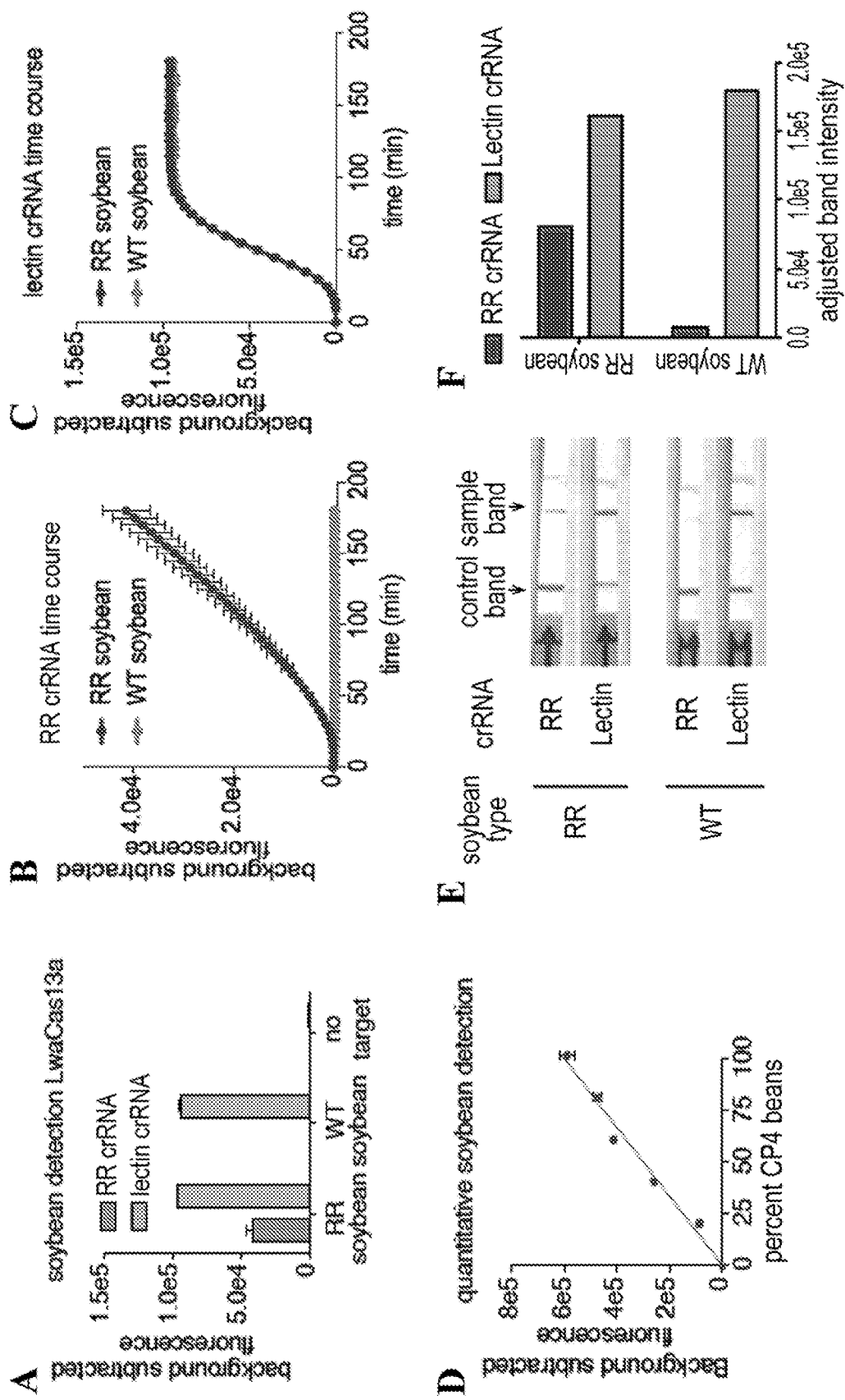
Figure 86:
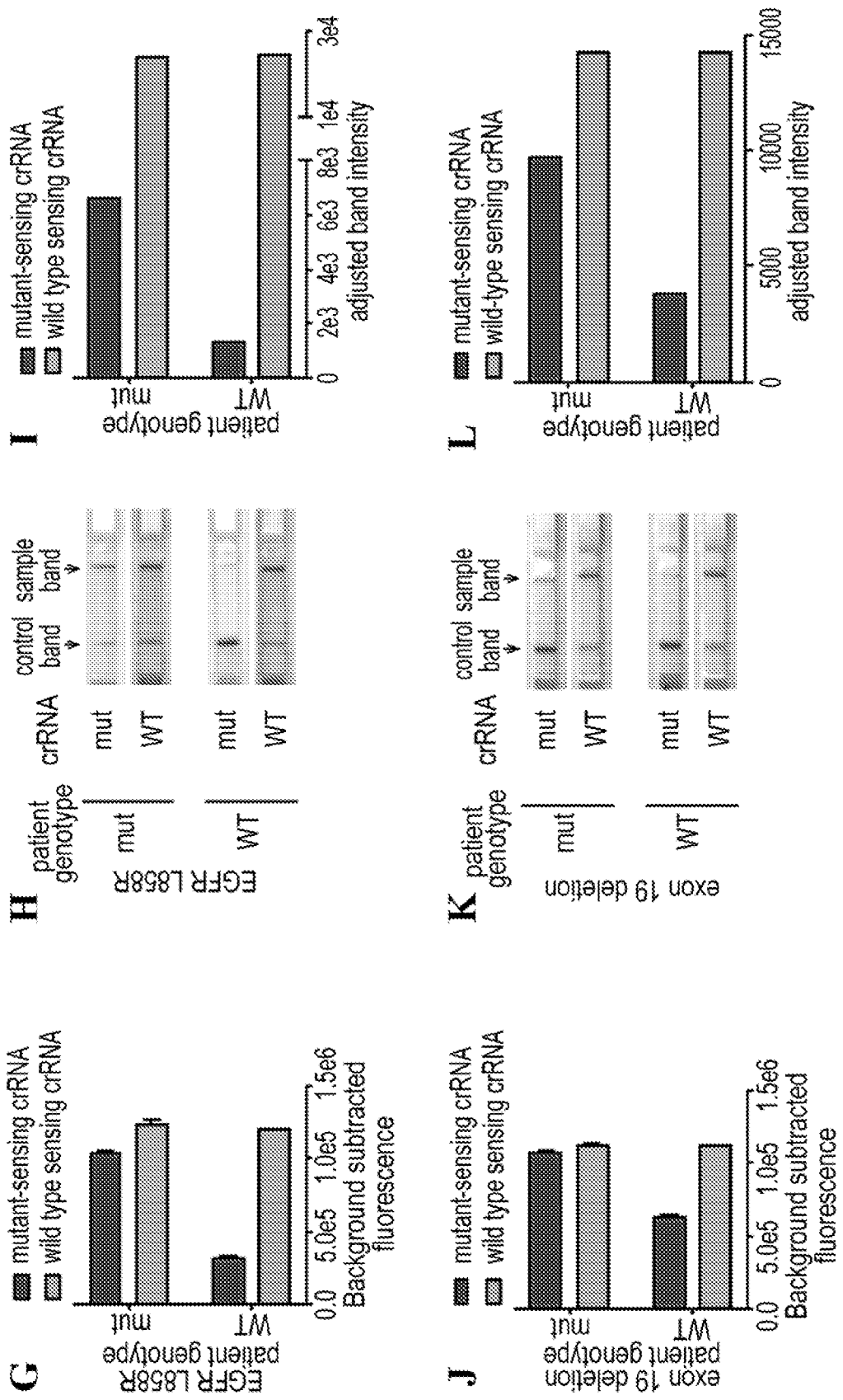

FIG. 86—Agricultural and point-of-care health applications with lateral-flow SHERLOCK. (A) Detection of either the CP4-EPSPS herbicide resistance gene or lectin control in CP4-EPSPS-modified (herbicide resistant) or WT soybean seeds using LwaCas13a. (B) Timecourse of CP4-EPSPS detection in herbicide resistant or WT soybeans. (C) Timecourse of lectin detection in herbicide resistant or WT soybeans. (D) Quantitation of CP4-EPSPS DNA content of mixtures of CP4-EPSPS and WT seeds with LwaCas13a. (E) Lateral flow detection of CP4-EPSPS herbicide resistance gene or lectin control in CP4-EPSPS-modified or WT soybean seeds using LwaCas13a. (F) Quantitation of band intensity from detection in (E). (G) Detection of EGFR L858R mutation in patient-derived cell-free DNA samples with either L858R or WT cancer mutations. (H) Lateral-flow detection of EGFR L858R mutation in patient-derived cell-free DNA samples with either L858R or WT cancer mutations. (I) Quantitation of band intensity from detection in (H). (J) Detection of EGFR exon 19 deletion mutation in patient-derived cell-free DNA samples with either exon 19 deletion or WT cancer mutations. (K) Lateral-flow detection of EGFR exon 19 deletion mutation in patient-derived cell-free DNA samples with either exon 19 deletion or WT cancer mutations. (L) Quantitation of band intensity from detection in (K).

Figure 87:
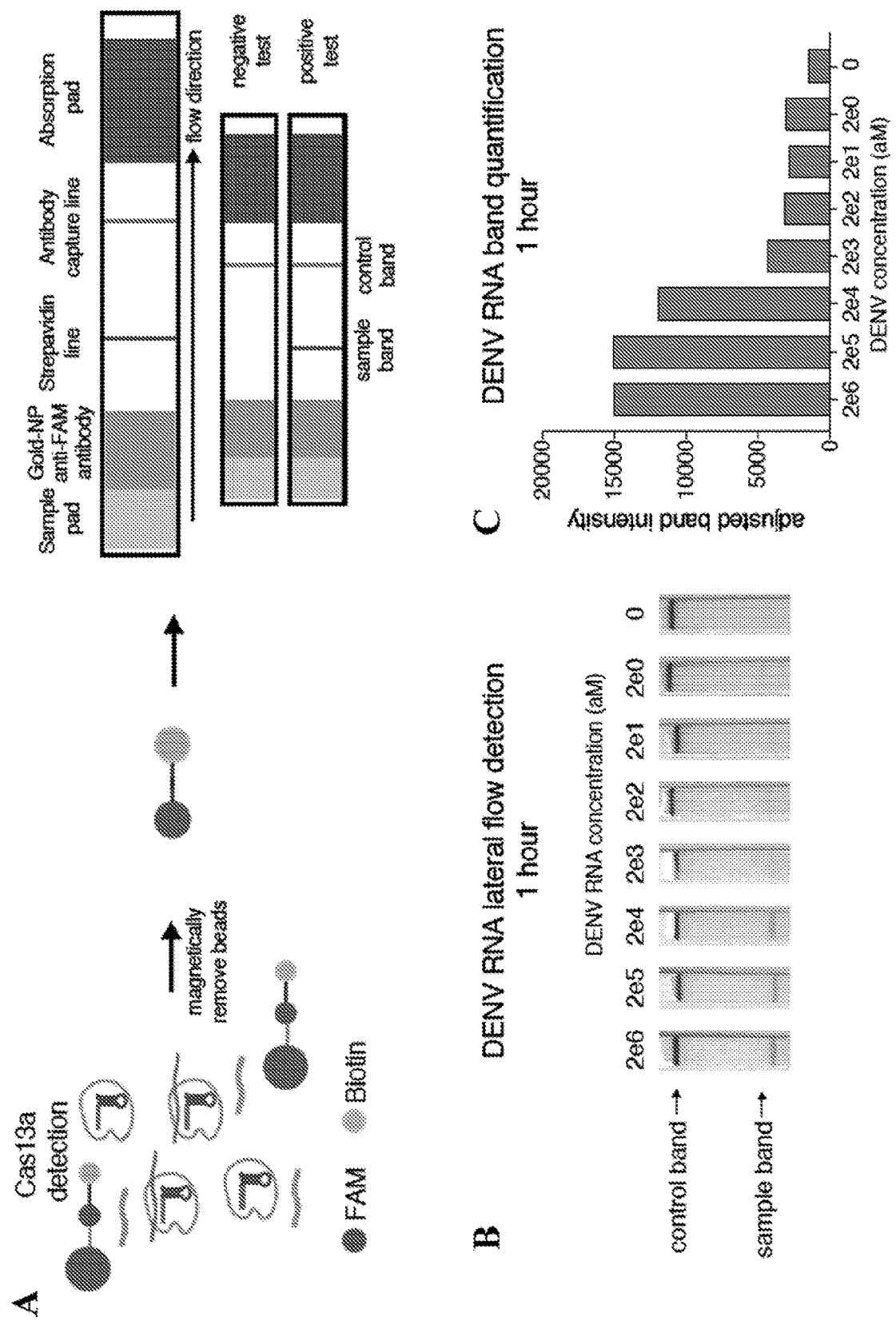

FIG. 87—Magnetic bead-based lateral flow SHERLOCK. (A) Schematic of magnetic-bead based lateral flow readout of SHERLOCK. Collateral activity cleaves lateral flow reporters from beads, allowing for detection. (B) Detection of synthetic Dengue RNA using magnetic-bead based lateral flow SHERLOCK with 1 hour of LwaCas13a reaction. (C) Quantitation of band intensity from detection in (B).

Figure 88:
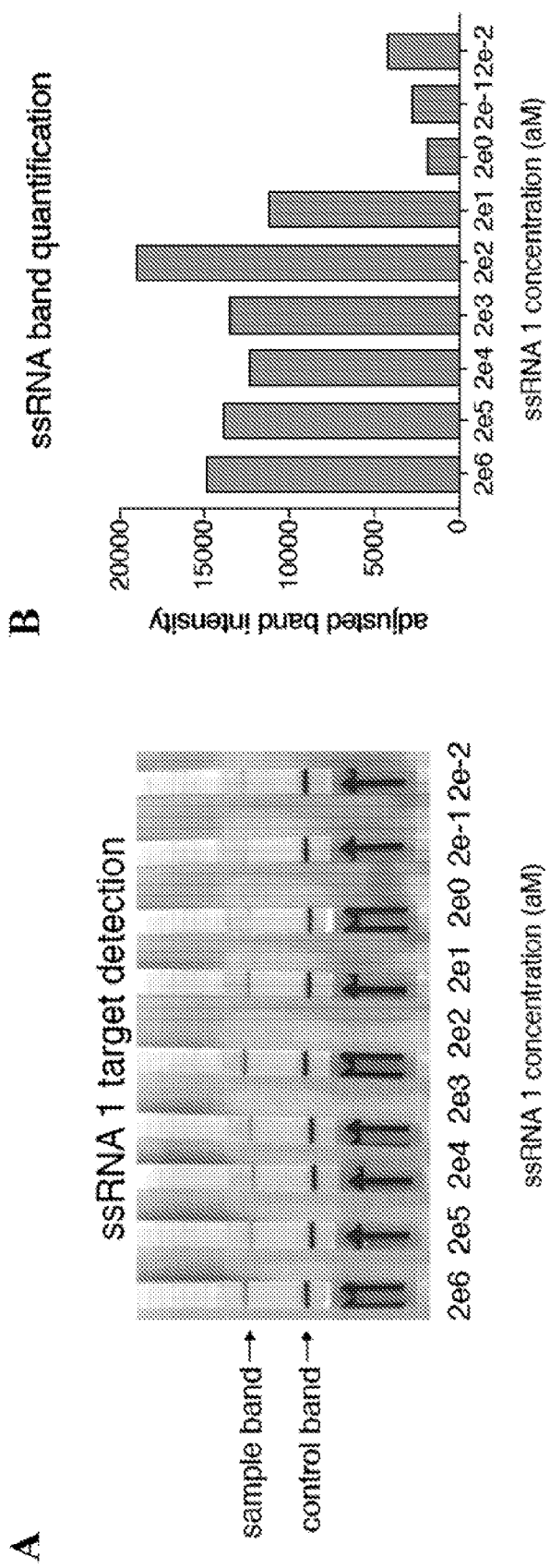

FIG. 88—SHERLOCK lateral flow detection of ssRNA1. (A) Detection of ssRNA 1 using lateral flow SHERLOCK at various concentrations of ssRNA 1. (B) Quantitation of band intensity from detection in (A).

Figure 89:
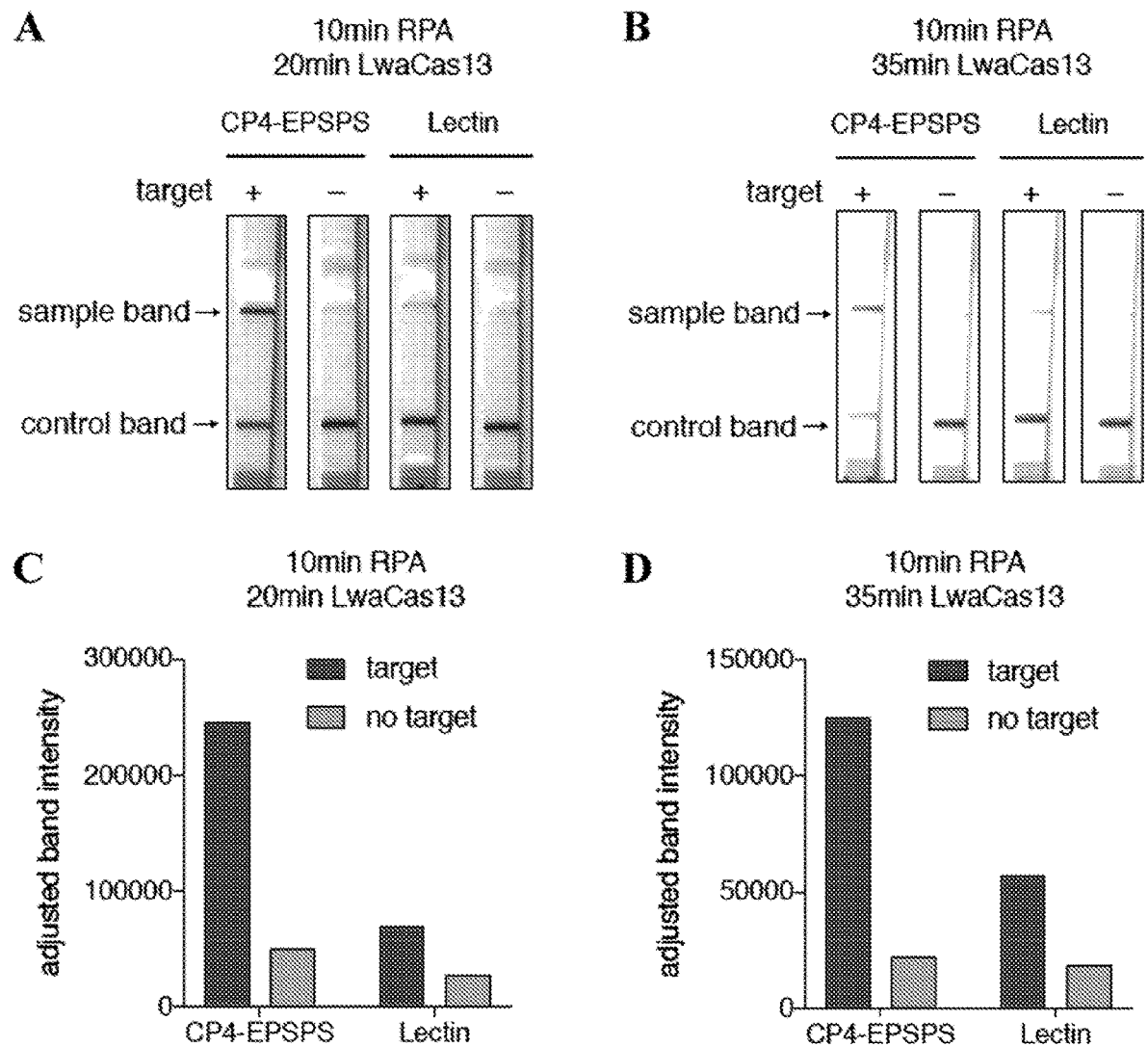

FIG. 89—SHERLOCK lateral flow detection of CP4 and lectin genes from crude plant extract. (A) Detection of RR (CP4 EPSPS gene) or lectin from direct soybean crude extract using lateral flow SHERLOCK with 10 minute RPA and 20 minute collateral detection. (B) Detection of RR (CP4 EPSPS gene) or lectin from direct soybean crude extract using lateral flow SHERLOCK with 10 minute RPA and 35 minute collateral detection. (C) Quantitation of band intensity from detection in (A). (D) Quantitation of band intensity from detection in (B).

Figure 90:
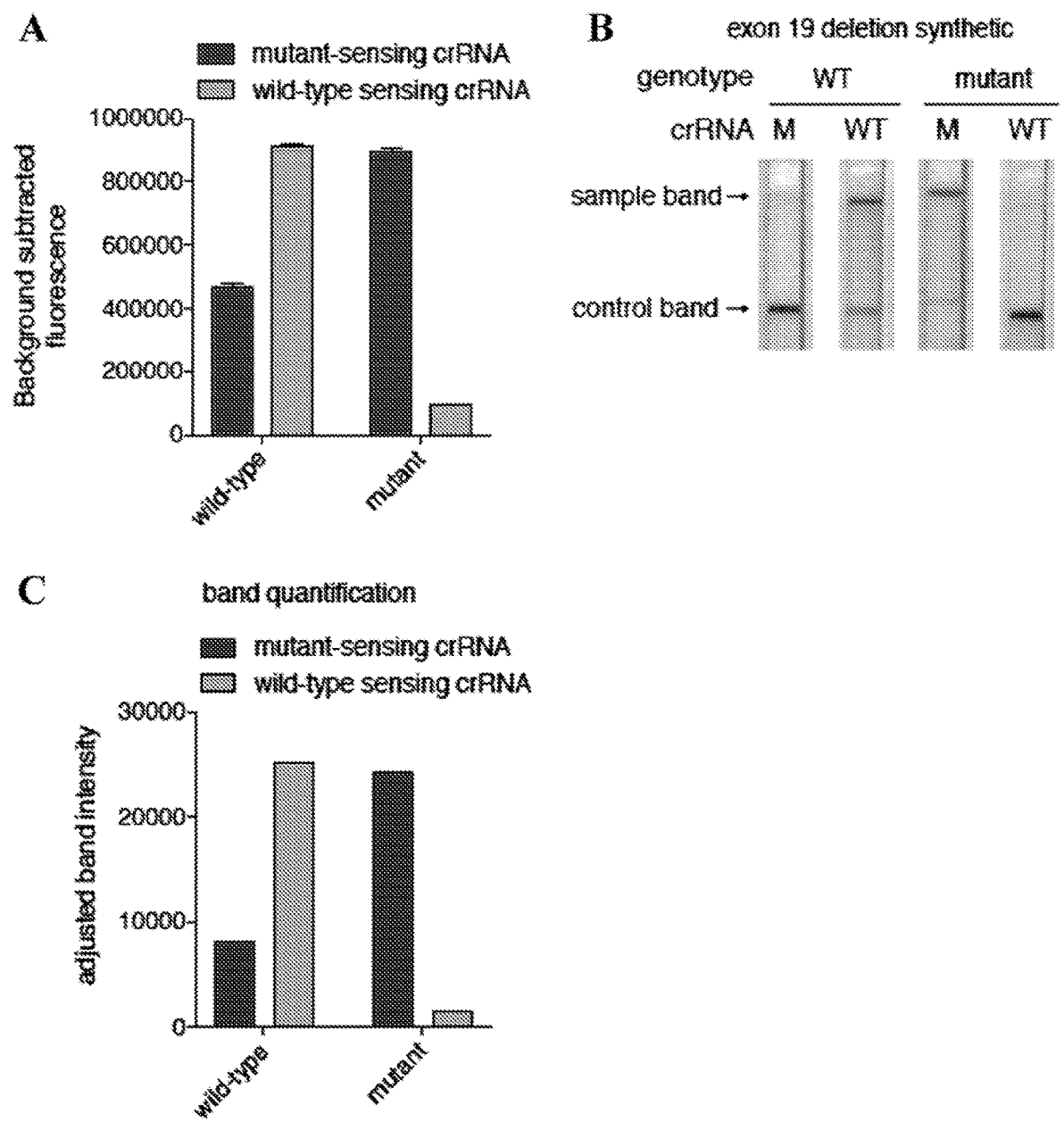

FIG. 90—SHERLOCK lateral flow detection of synthetic exon 19 deletion samples. (A) Detection of EGFR exon 19 deletion mutation in synthetic DNA samples with either exon 19 deletion or WT genotype using LwaCas13a. (B) Lateral-flow detection of EGFR exon 19 deletion mutation in synthetic DNA samples with either exon 19 deletion or WT genotype using LwaCas13a. (C) Quantitation of band intensity from detection in (B).

Figure 91:
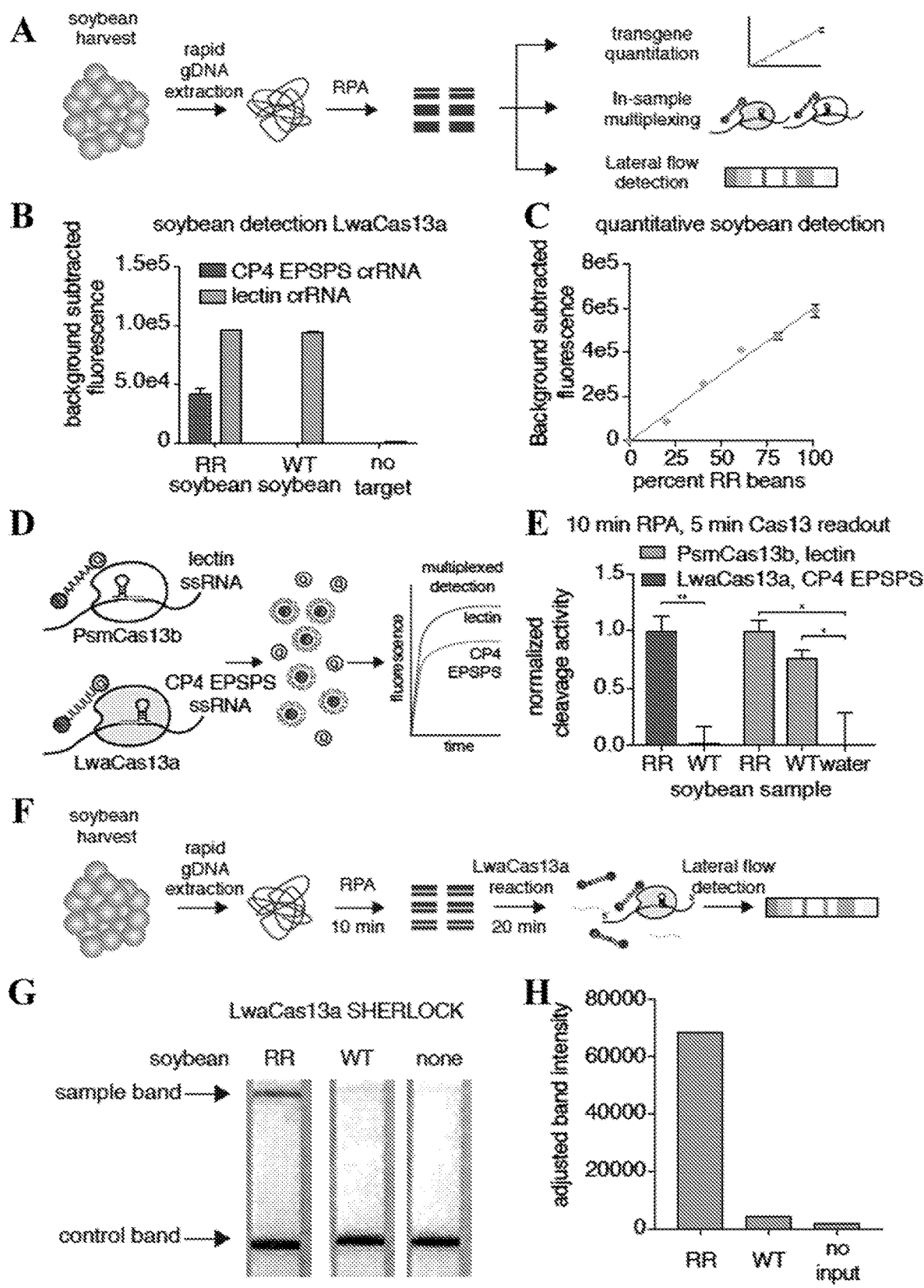

FIG. 91—illustrates detection of soybean herbicide resistance gene with SHERLOCK. (A) A schematic of SHERLOCK in combination with a rapid genomic DNA extraction method allowing for detection of soybean transgenes in a quantitative, multiplexed, and portable manner via lateral flow strips. (B) SHERLOCK detection of the Roundup Ready (RR) transgene CP4 EPSPS and a positive control gene lectin using LwaCas13a and a fluorescent reporter. (C) Quantitative SHERLOCK detection of the percent of the Roundup Ready (RR) transgene CP4 EPSPS in a complex mixture of soybeans. (D) Schematic of in-sample multiplexed detection of CP4 EPSPS transgene and lectin using two-color SHERLOCK with LwaCas13a and PsmCas13b. (E) In-sample multiplexed detection of the CP4 EPSPS transgene and lectin using two-color SHERLOCK with LwaCas13a and PsmCas13b. Lectin detection of soybeans is compared to a no input water control sample. (F) Schematic of rapid soybean transgene detection using SHERLOCK lateral flow strips. (G) Rapid detection of the CP4 EPSPS transgene within 30 minutes on lateral flow strips using SHERLOCK and LwaCas13a. (H) Quantitation of the sample band intensities from the lateral flow strips in G.

Figure 92:
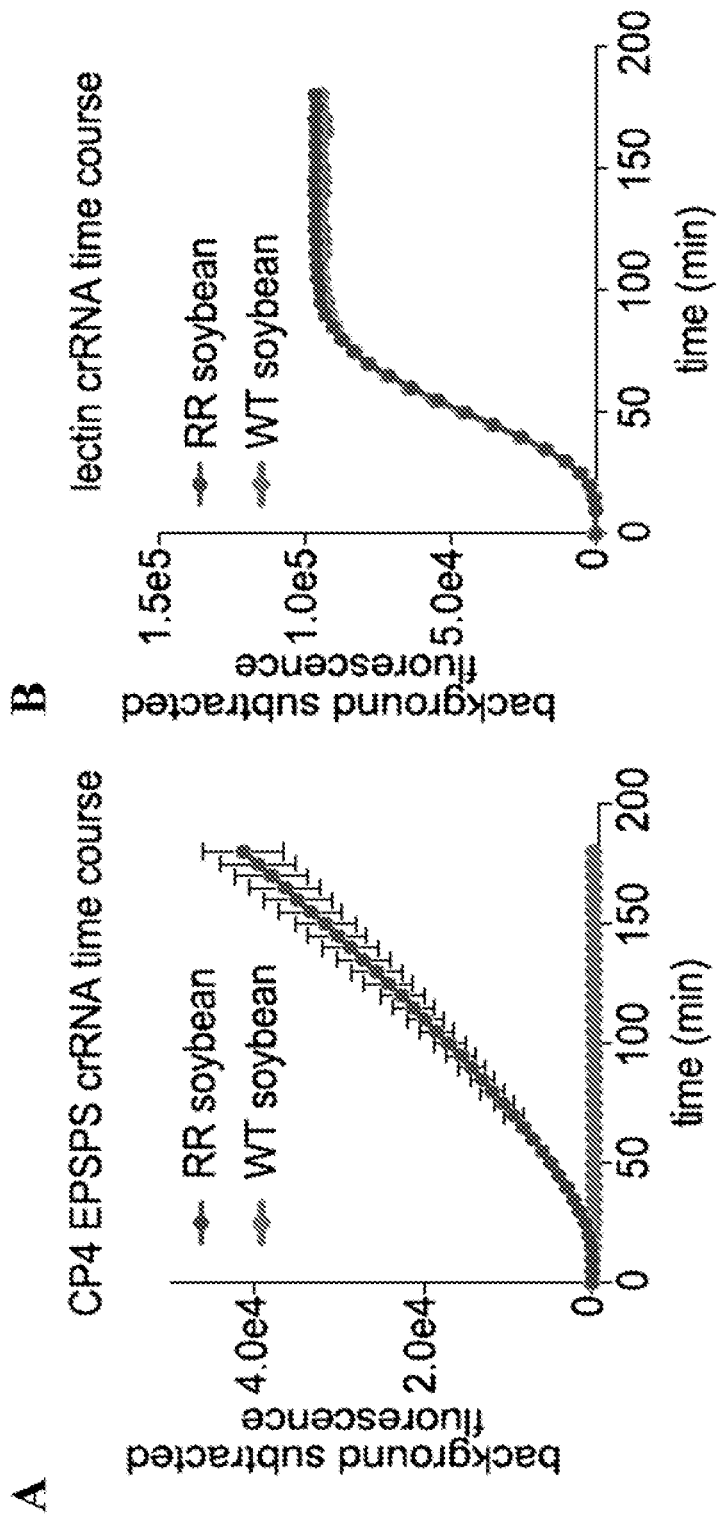

FIG. 92—illustrates kinetics of plant gene detection with SHERLOCK. (A) Detection of the Roundup Ready (RR) transgene CP4 EPSPS using SHERLOCK and LwaCas13a in RR soybeans and wild type (WT) soybeans over time. (B) Detection of the lectin gene using SHERLOCK and LwaCas13a in Roundup Ready (RR) soybeans and wild type (WT) soybeans over time.

Figure 93:
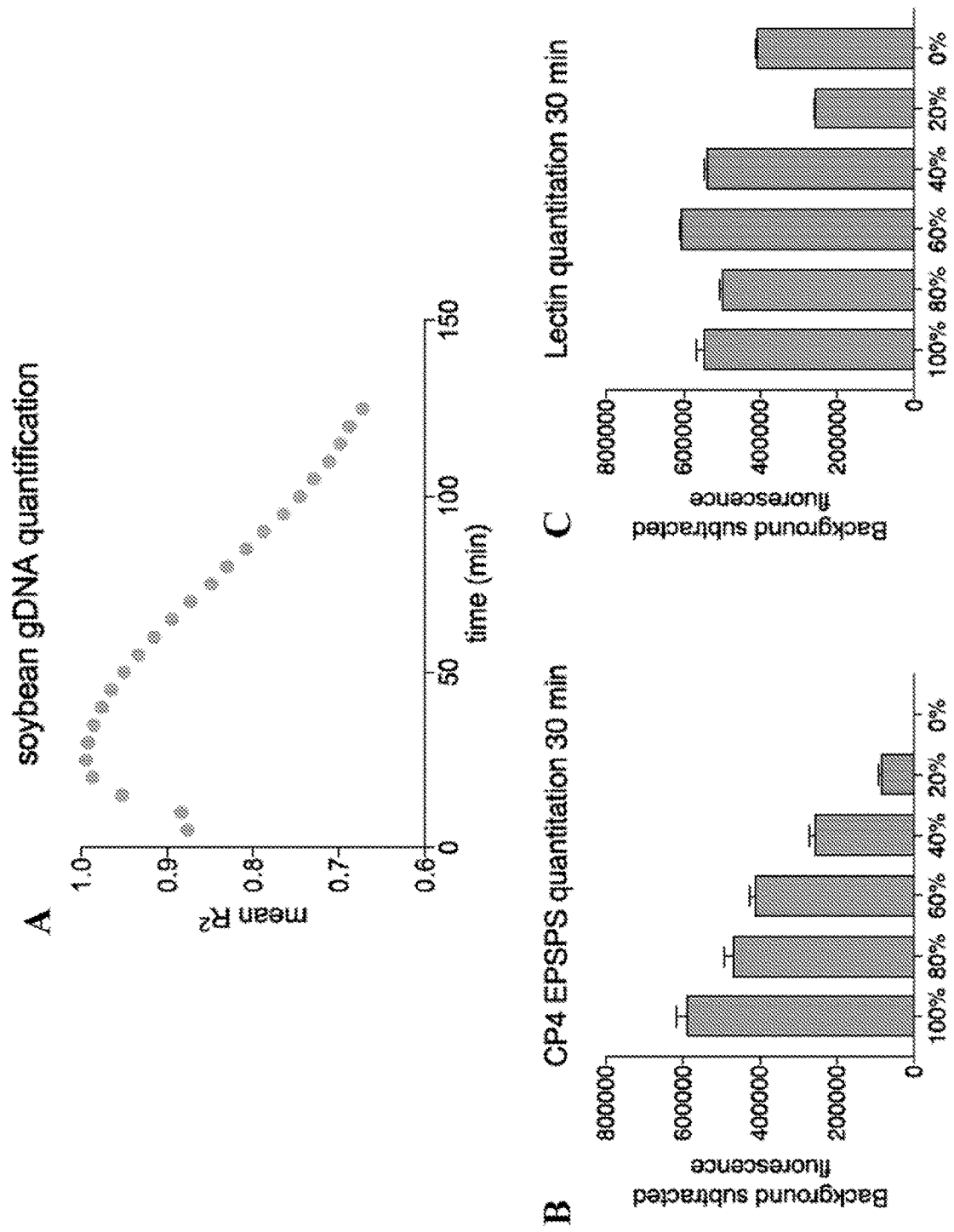

FIG. 93—illustrates quantitative SHERLOCK of the CP4 EPSPS transgene in a population of soybeans. (A) Correlation of the SHERLOCK signal with percent Roundup Ready (RR) soybeans at different time points of the SHERLOCK detection reaction. (B) SHERLOCK signal detection of the CP4 EPSPS transgene from soybean mixtures containing varying amounts of Roundup Ready (RR) soybeans at the 30 minute time point (the time point with maximal correlation as shown in a). (C) SHERLOCK signal detection of the lectin gene from soybean mixtures containing varying amounts of Roundup Ready (RR) soybeans at the 30 minute time point (the time point with maximal correlation as shown in A).

Figure 94:
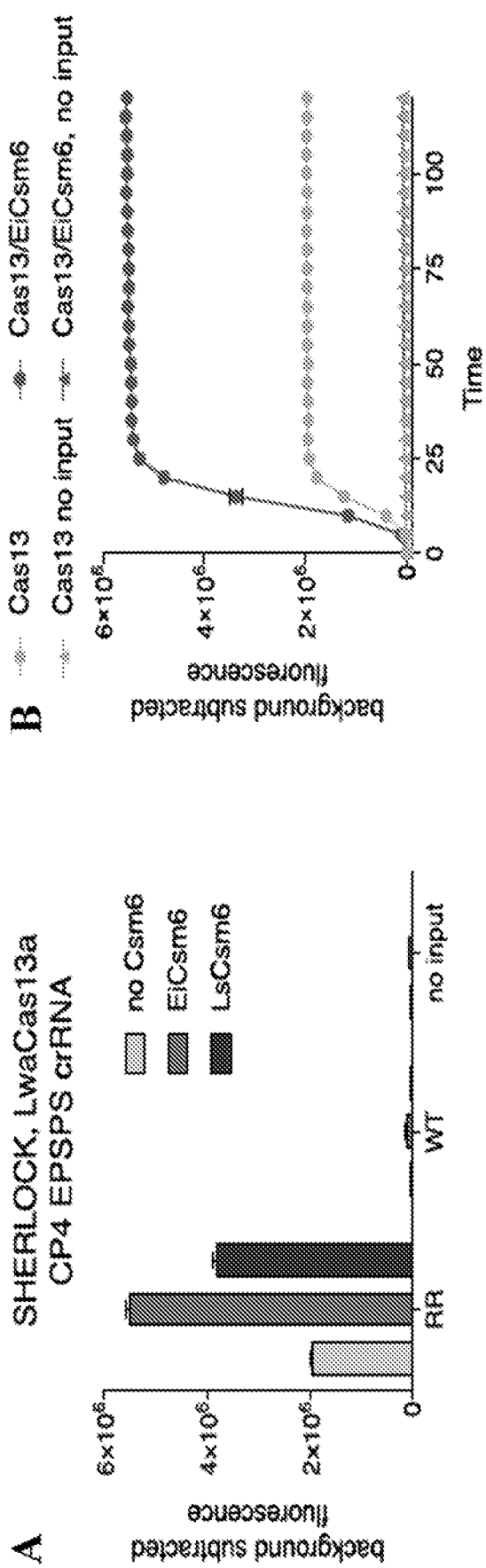

FIG. 94—illustrates SHERLOCK detection of CP4 EPSPS transgene with Csm6 signal amplification. (A) SHERLOCK detection of the Roundup Ready (RR) transgene CP4 EPSPS with LwaCas13a and signal amplification with EiCsm6 or LsCsm6. (B) Kinetics of EiCsm6 amplification of SHERLOCK detection of the CP4 EPSPS transgene with LwaCas13a.

Figure 95:
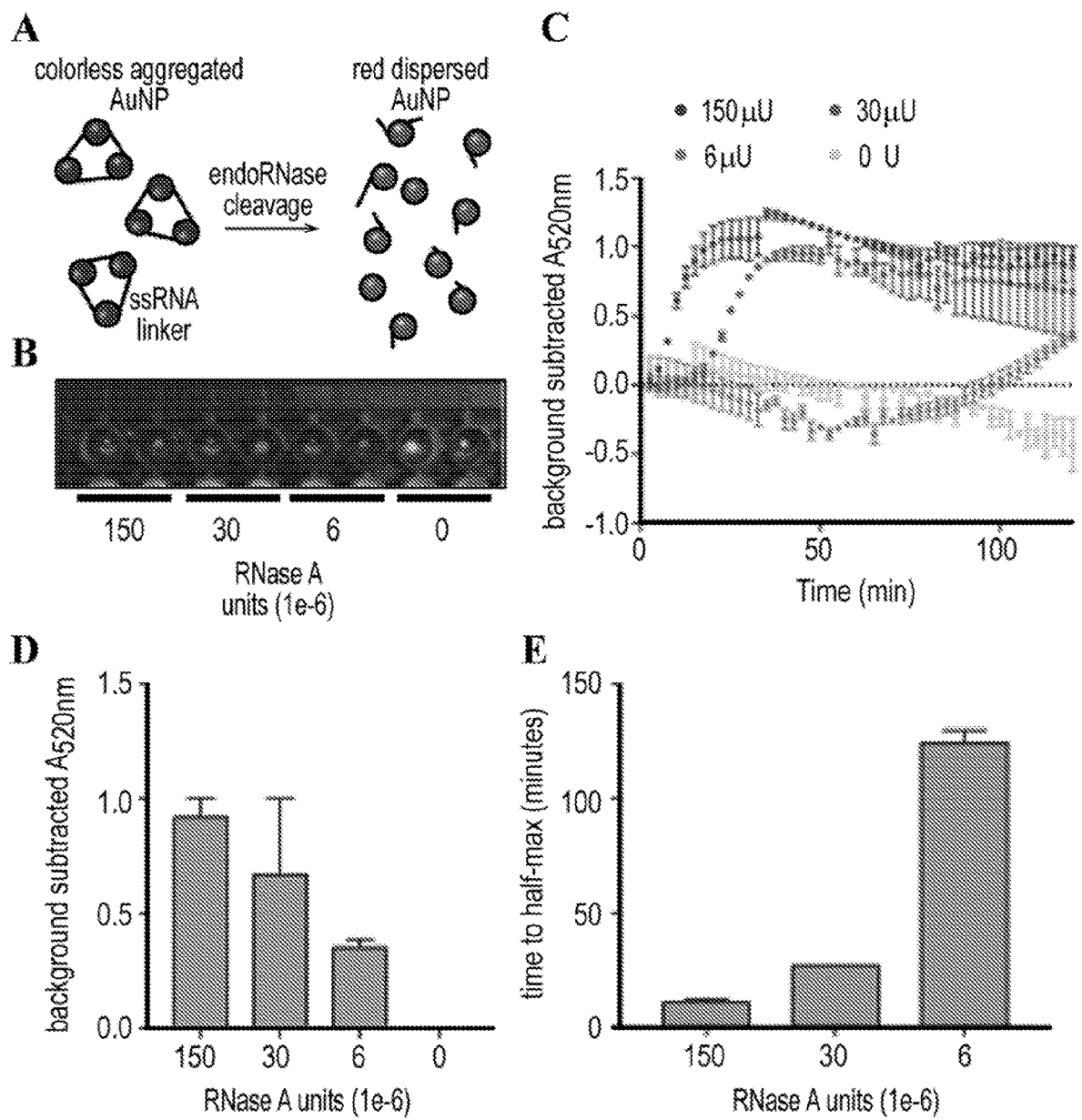

FIG. 95.—provides results of colorimetric detection of RNase activity with gold nanoparticle aggregation. A) schematic of gold-nanoparticle based colorimetric readout for RNase activity. In the absence of RNase activity, RNA linkers aggregate gold nanoparticles, leading to loss of red color. Cleavage of RNA linkers releases nanoparticles and results in red color change.

Figure 96:
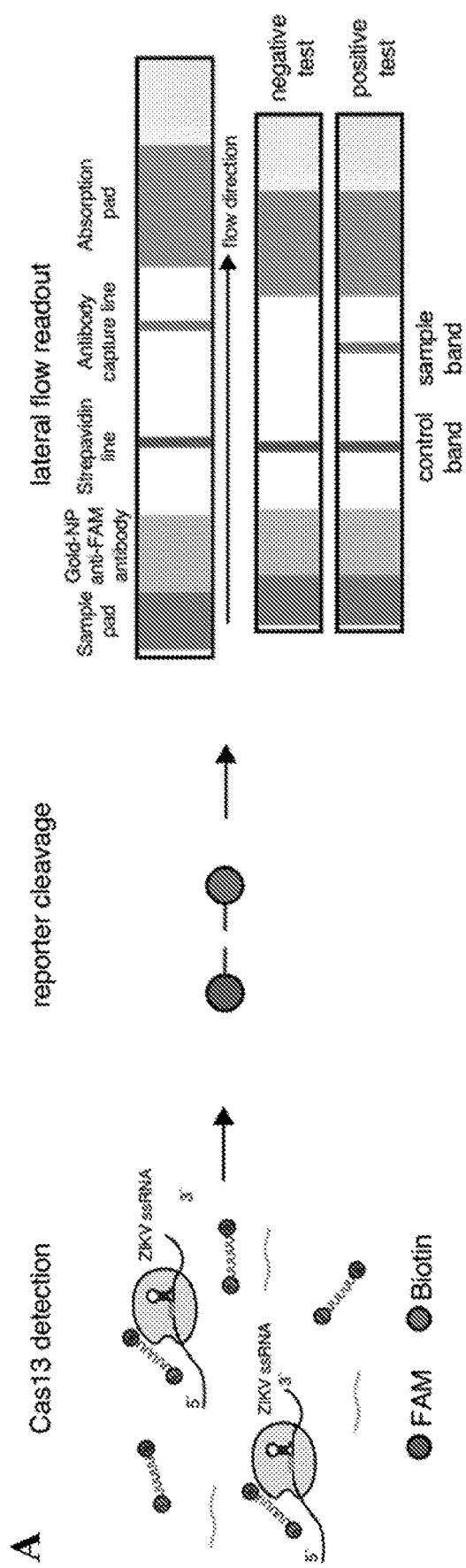
Figure 96:
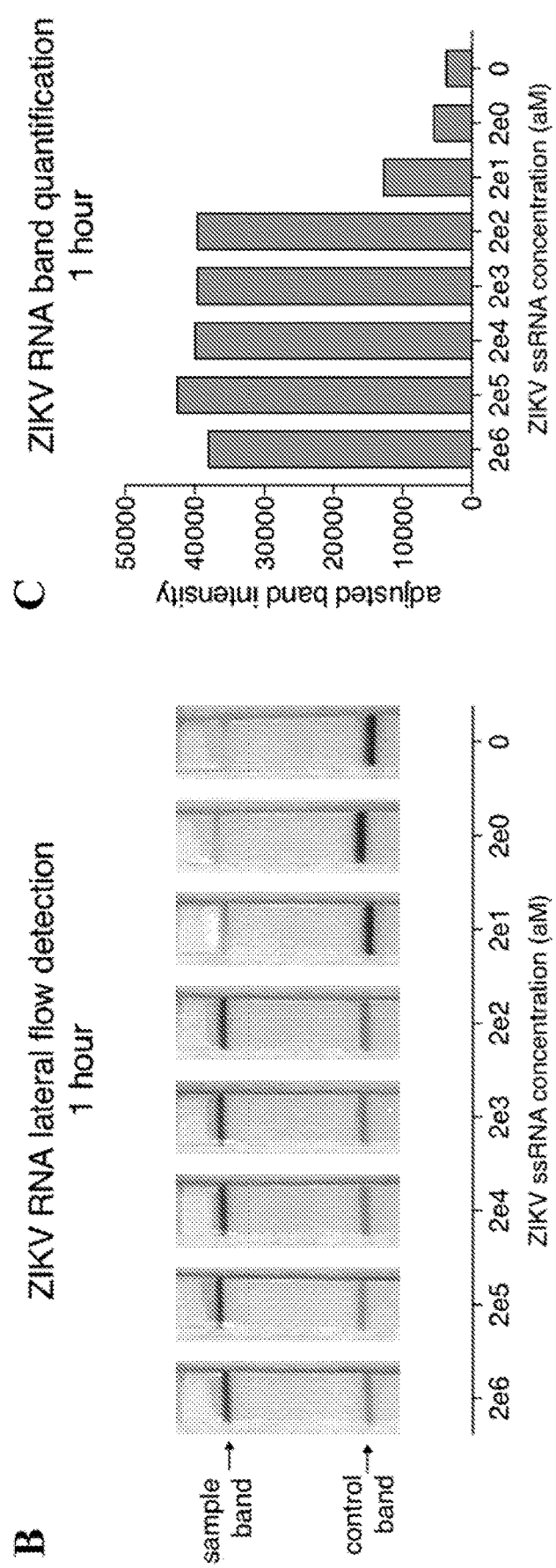
Figure 96:
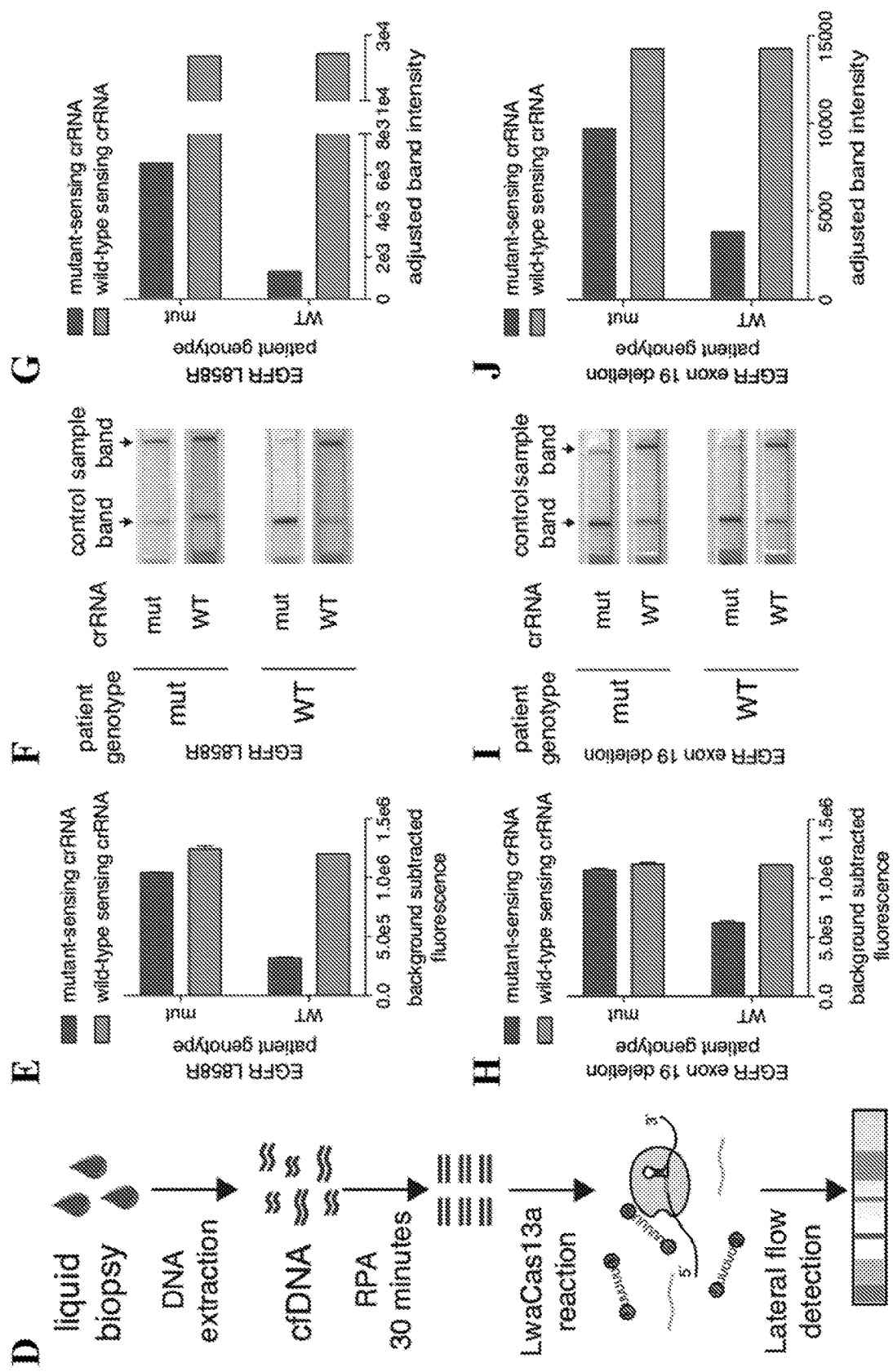
Figure 96:
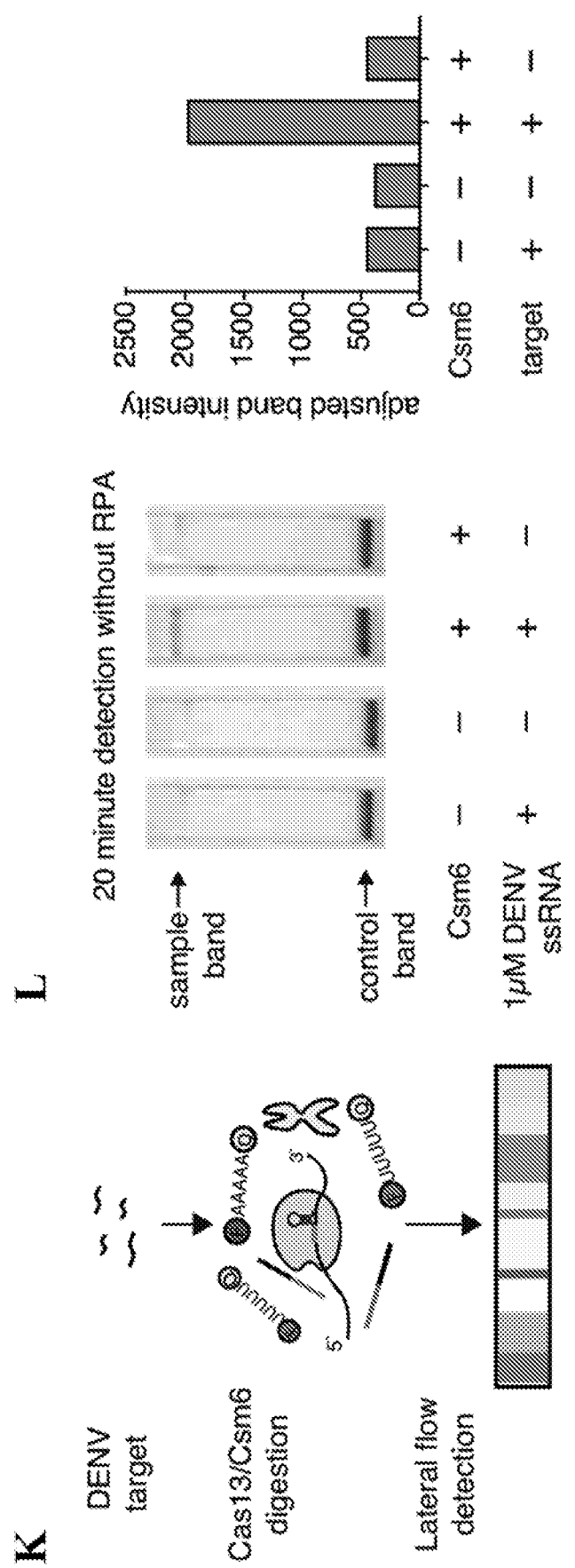

FIG. 96.—A) provides a schematic of lateral flow detection, in accordance with certain example embodiments. B) Detection of synthetic ZIKA ssRNA using lateral flow embodiment with 1 hour of LwaCas13 reaction. C) Quantiation of band intensity form detection in (B). C) Quantitation of band intensity from detection in (B). Schematic of lateral flow detection of therapeutically relevant EGFR mutations from patient liquid biopsy samples. E) Detection of EGFR L858R mutation in patient-derived cell-free DNA samples with either L858R or WT cancer mutations. Values represent mean+/−S.E.M. F). Lateral-flow detection of EGFR L858R mutation in patient-derived cell-free DNA samples with either L858R or WT alleles. G) Quantiation of band intensity form (E). H) Detection of EGFR exon 19 deletion mutation in patient-derived cell-free DNA samples with either exon 19 deletion or WT alleles. Values represent mean+/−S.E.M. I) Lateral-flow detection of EGFR exon 19 deletion mutation in patient-derived cell-free DNA samples with either exon 19 deletion or WT alleles. J) Quantiation of band intensity from detection in (H). K) Schematic of lateral flow readout of EiCsm6-enhanced LwaCas13a detection of DENV ssRNA. L) EiCsm6-enhanced lateral flow detection of synthetic DENV RNA in combination with LwaCas13a without preamplification by RPA. Band intensity quantitation is shown to right.

Figure 97:
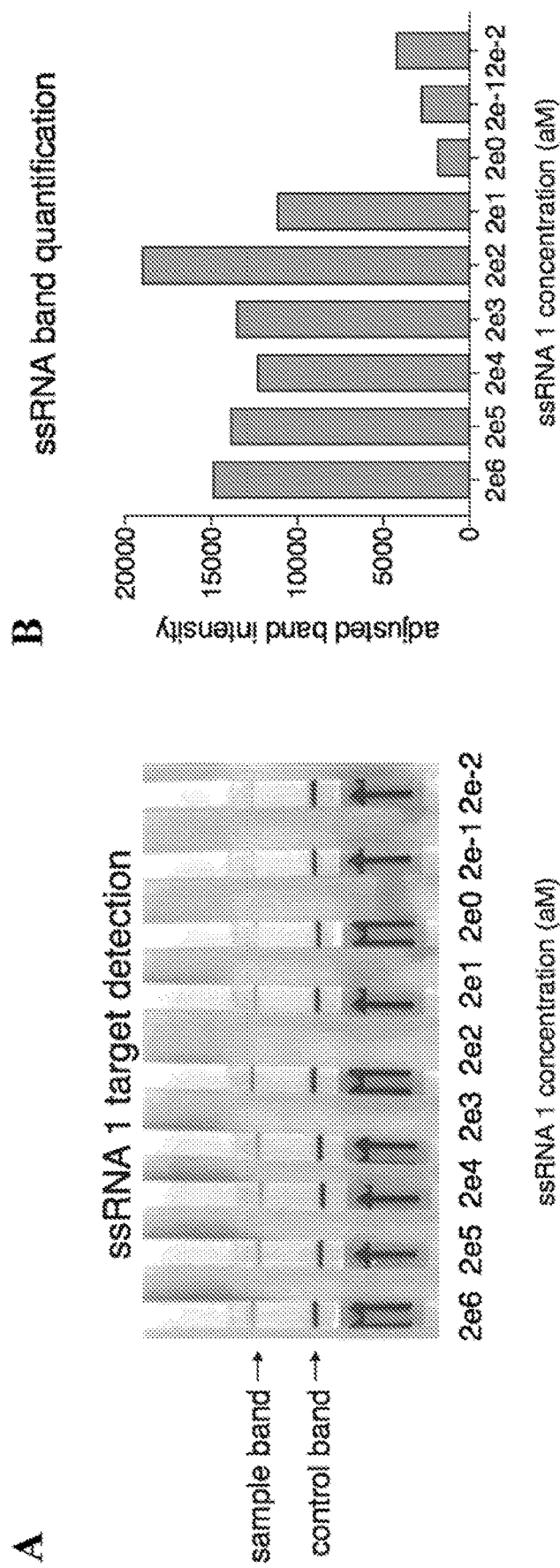

FIG. 97—A) detection of ssRNA 1 using lateral flow embodiment at various concentrations. B) Quantitation of band intensity from detection in (A).

Figure 98:
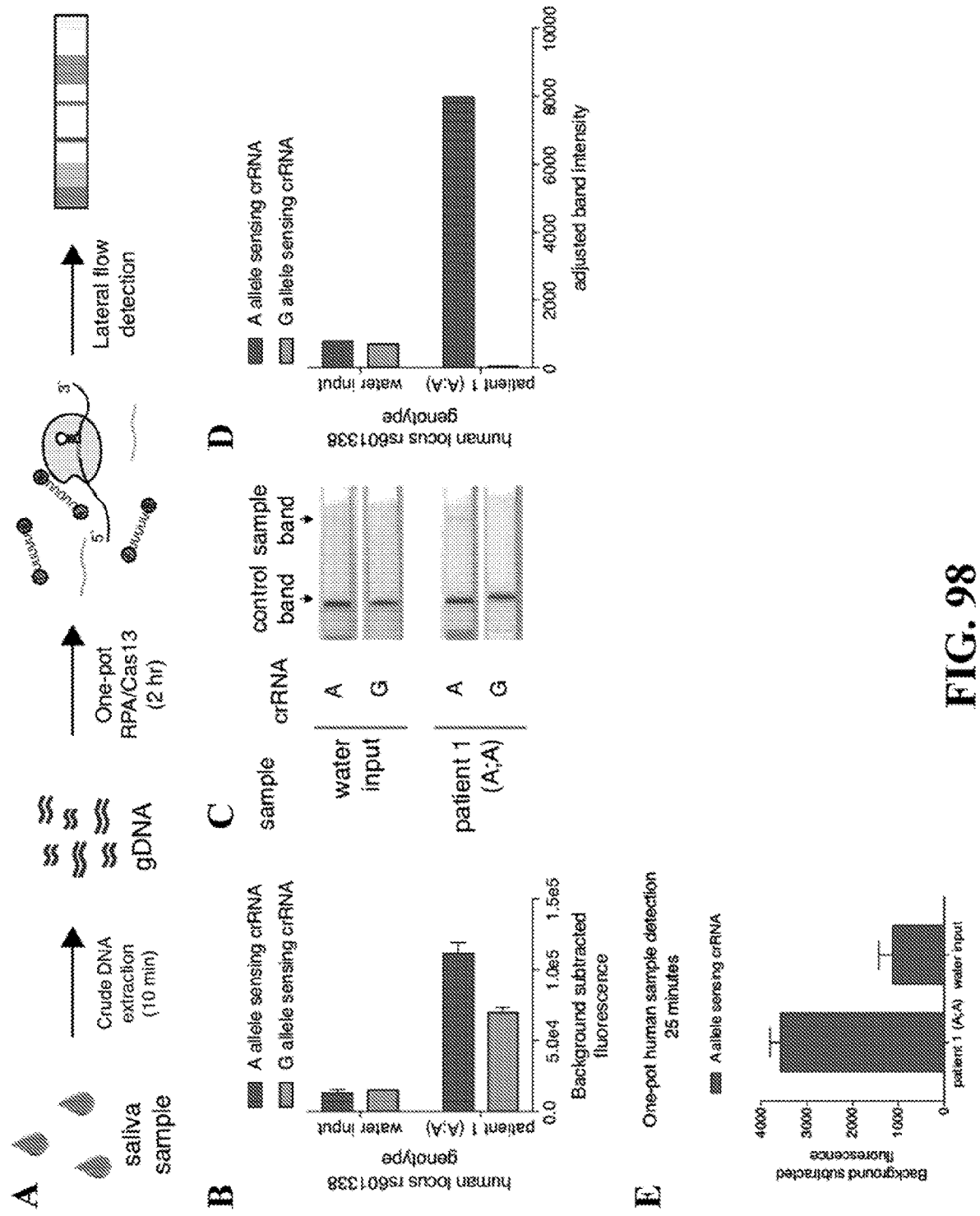

FIG. 98. One-pot lateral-flow genotypoing of genomic DNA from saliva. A) Schematic for rapid extraction and one-pot detection of genomic DNA from patient saliva. B). Detection of rs601338genotypes in from crude genomic DNA extraction compared to water input. C). Lateral-flow detection of rs601338 genotypes in from crude genomic DNA extraction. D). Quantitation of band intensity from detection in (C) E) Detection of patient DNA in 25 minutes from crude saliva FIG. 99—SHERLOCK lateral flow detection of synthetic cfDNA samples. A) Detection of EGFT exon 19 deletion mutation in synthetic DNA samples with either exon 19 deletion of WT genotype using LwaCas13a. B) Lateral-flow detection of EGFR exon 19 deletion mutation in synthetic DNA samples with either exon 19 deletion of WT genotype using LwaCas13a. C) Quantitation of band intensity from detection in (B). D) Detection of EGFR exon 19 deletion mutation in 4 patient cfDNA samples with either exon 19 deletion or WT genotype using LwaCas13a. E) Detection of EGFR T790M deletion mutation in synthetic DNA samples with either T790M or WT genotype using LwaCas13. K) Detection of EGFR T790M deletion mutation in patient cfDNA samples with either T790M or WT genotype using LwaCas13a (*, p<0.05; n.s, not significant; bars represent ±s.e.m.). In this case, patient 4's T790M allelic fraction, as verified by targeted sequencing was 0.6%. Applicant was still able to see significant detection of this low allelic fraction due to the sensitivity and specific tof assay, aggreing with previous results showing detection greater than 0.1% allelic fraction samples (3). Additionally, because the Bsu polymerase in RPA has a minimum error rate of 10-5 errors per base incorporated per cycle (25), it is expected that about 0.02% of amplicons contain an error at the mutation to be sensed. Because spurious signal will only be detected if the correct mutation is formed on a wild type amplicon, then only 0.0067% of amplicons will have a mutation that causes spurious detection of the mutation. As most patients do not have below 0.01% allelic faction of cfDNA mutations, this error rate is acceptable.

Figure 100:
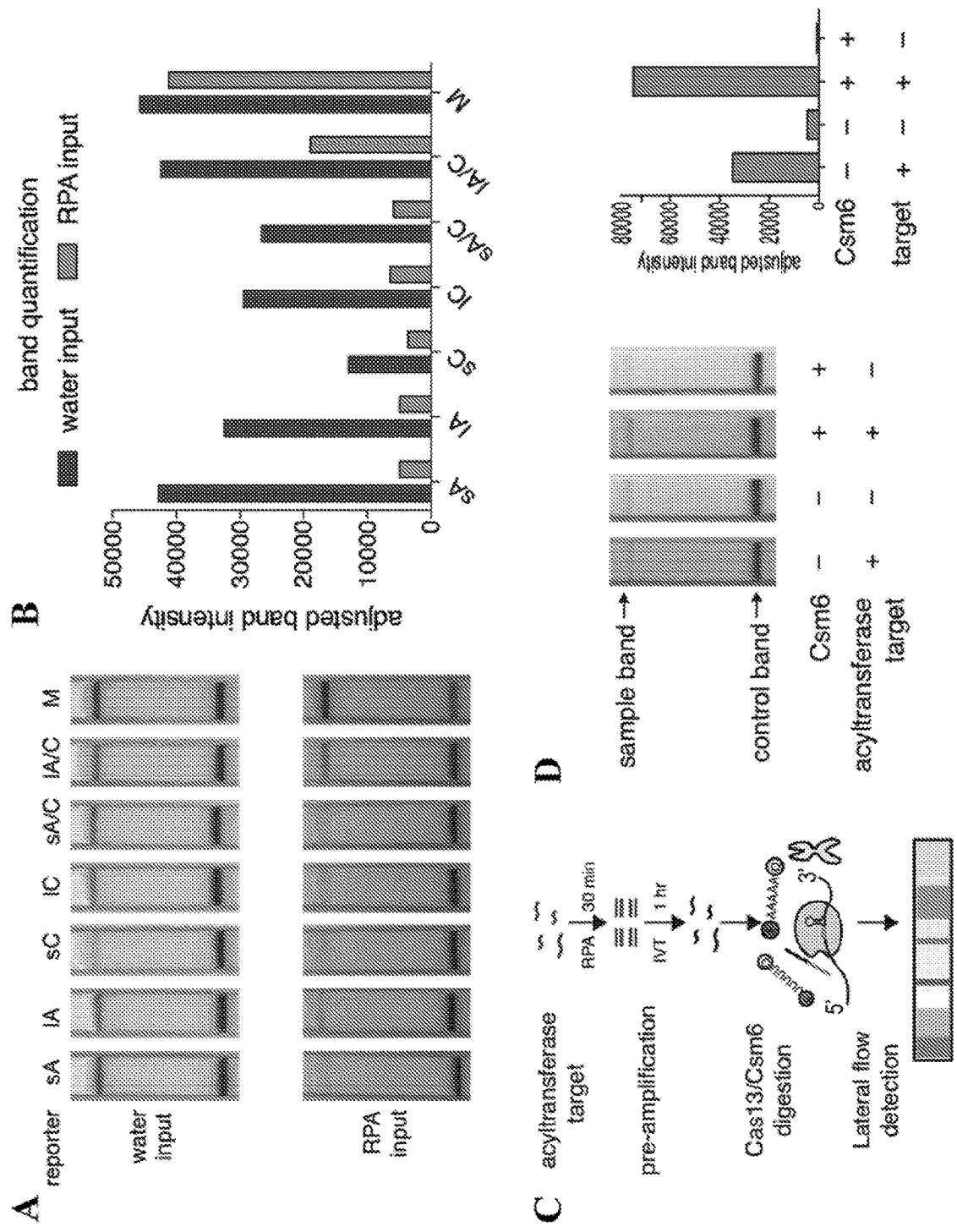

FIG. 100—Lateral flow Csm6-enhanced SHERLOCK with different reporter combinations. A) Lateral-flow detection of Csm6-enhanced SHERLOCK with various reporter designs. sA: short-polyA sensor; 1A: long polyA sensor; sC: Short poly-C sensor; 1C; long poly-C sensor; sA/C: short poly-A/C sensor; 1A/C: long poly-A/C sensor; M: mixed RNase alert-like sensor. B) Quantiation of band intensity from detection in (A). C) Schematic of lateral flow readout of EiCsm6-enhanced LwaCas13a SHERLOCK detection of acyltransferase ssDNA with separate RPA and IVT steps. D) EiCsm6-enhanced lateral flow SHERLOCK with *P. aeruoginosa* acyltransferase gene in combination with LwasCas13a. Band intensity quantiation is shown to the right.

Figure 101:
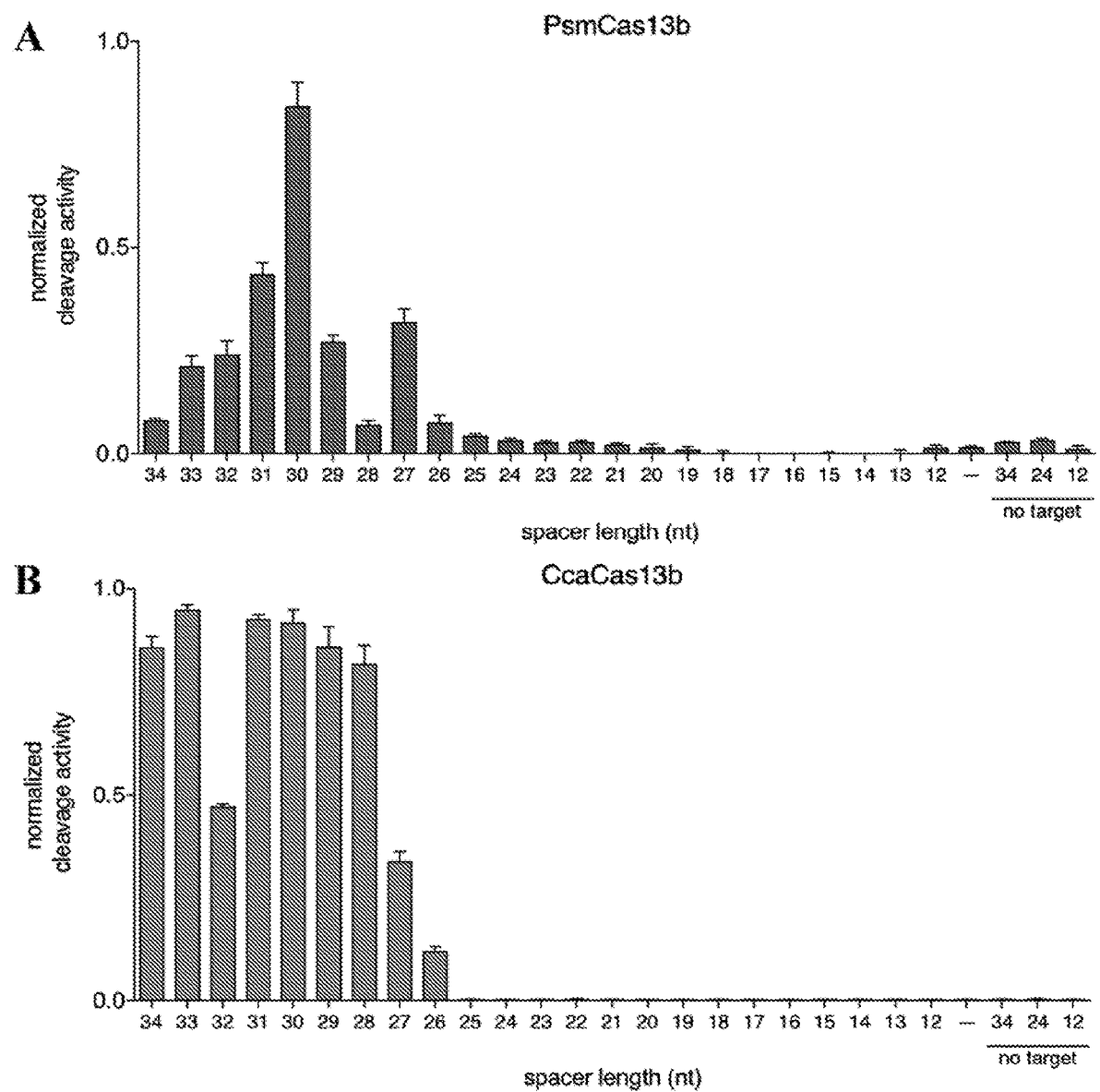

FIG. 101—Effect of crRNA spacer length on Casd13 ortholog cleavage. A) Cleavage activity of PsmCas13b with ssRNA1-targeting crRNAs of varying spacer lengths. B) Cleavage activity of CcaCas13b with ssRNA1-targeting crRNAs of varying spacer lengths.

Figure 102:
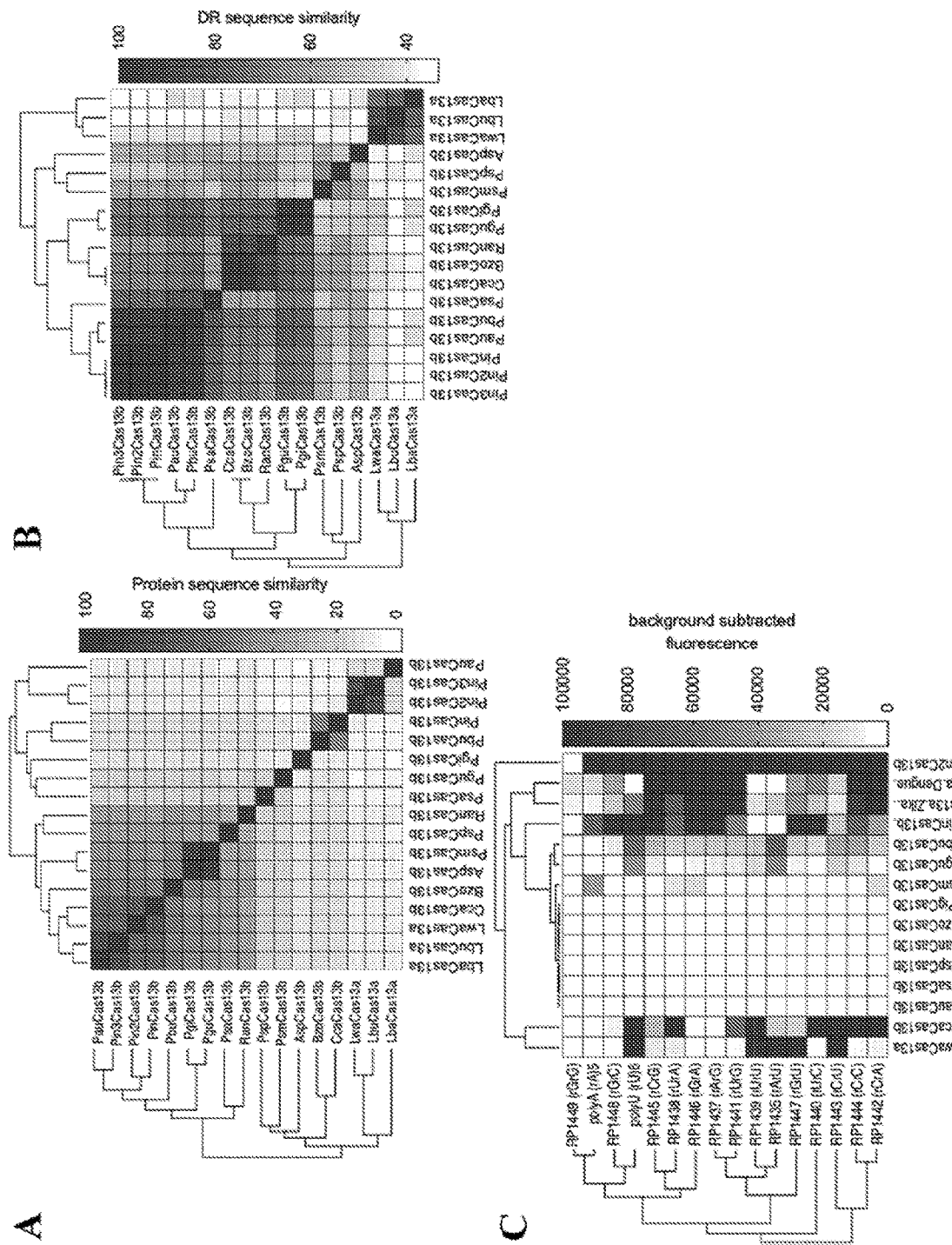

FIG. 102—Relationship of Cas13 families with di-nucleotide cleavage preferences. A) Protein sequence similarity matrix based on multiple protein sequence alignment of several Cas13a and Cas13b orthologs members. Clustering is shown based on Euclidean distance. B) Direct repeat sequence similarity matrix based on multiple sequence alignment of several Cas13a and Cas13b direct repeat sequences. Clustering is shown based on Euclidean distance. C) Clustering of the Cas13 cleavage activity base preferences of dinucleotide motif reporters.

Figure 103B:
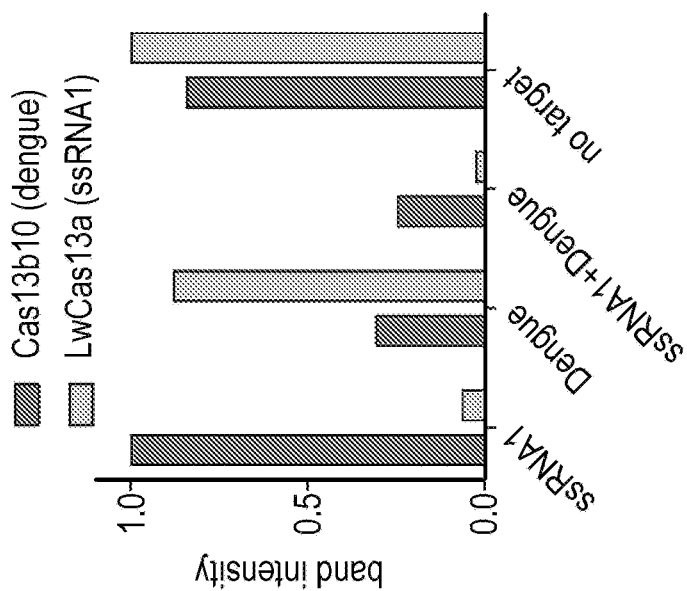
Figure 103A:
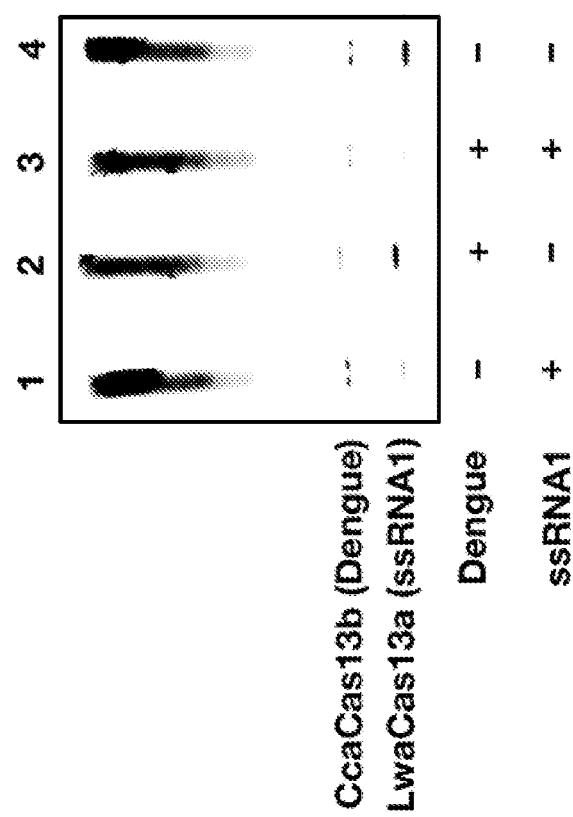

FIGS. 103A and 103B—Show results of lateral flow assay for Dengue RNA and ssRNA1 using a Cas13b10 probe for Dengue and a LwaCas13a probe for ssRNA1.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +1-5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

"C2c2" is now referred to as "Cas13a", and the terms are used interchangeabily herein unless indicated otherwise.

All publications, published patent documents, and patent applications cited herein are hereby incorporated by reference to the same extent as though each individual publication, published patent document, or patent application was specifically and individually indicated as being incorporated by reference.

Overview

The embodiments disclosed herein utilize RNA or DNA targeting effectors to provide a robust CRISPR-based diagnostic with attomolar sensitivity. Embodiments disclosed herein can detect both DNA and RNA with comparable levels of sensitivity and can differentiate targets from non-targets based on single base pair differences. Moreover, the embodiments disclosed herein can be prepared in freeze-dried format for convenient distribution and point-of-care (POC) applications. Such embodiments are useful in multiple scenarios in human health including, for example, viral detection, bacterial strain typing, sensitive genotyping, and detection of disease-associated cell free DNA. In certain embodiments, the present invention is used for rapid detection of foodborne pathogens using guide RNAs specific to a pathogen (e.g., *Campylobacter jejuni, Clostridium perfringens, Salmonella* spp., *Escherichia coli, Bacillus cereus, Listeria monocytogenes, Shigella* spp., *Staphylococcus aureus, Staphylococcal enteritis, Streptococcus, Vibrio cholerae, Vibrio parahaemolyticus, Vibrio vulnificus, Yersinia enterocolitica* and *Yersinia pseudotuberculosis, Brucella* spp., *Corynebacterium ulcerans, Coxiella burnetii,* or *Plesiomonas shigelloides*).

In one aspect, the embodiments disclosed herein are directed to a nucleic acid detection system comprising a CRISPR system, one or more guide RNAs designed to bind to corresponding target molecules, a reporter construct, and optional amplification reagents to amplify target nucleic acid molecules in a sample. The reporter construct is a molecule that comprises an oligonucleotide component (DNA or RNA) that can be cleaved by an activated CRISPR effector protein. The composition of the oligonucleotide component may be generic i.e. not the same as a target molecule. The reporter construct is configured so that it prevents or masks generation of a detectable positive signal when in the uncleaved configuration, but allows or facilitates generation of a positive detectable signal when cleaved. In the context of the present invention, reporting constructs comprising a first molecule and a second molecule connected by an RNA or DNA nucleic acid linker. Use of an RNA or DNA linker will depend on whether the CRISPR effector protein(s) used have RNA or DNA collateral activity. The first and second molecule are generally part of a binding pair, where the other binding partner is affixed to the lateral flow substrate as described in further detail below. The systems further comprise a detection agent that specifically binds the second molecule and further comprises a detectable label.

For ease of reference, these systems may be referred to herein as SHERLOCK systems and the reactions they facilitate as SHERLOCK reactions. If a target molecule is present in a sample, the corresponding guide molecule will guide the CRSIPR Cas/guide complex to the target molecule by hybridizing with the target molecule, thereby triggering the CRISPR effector protein's nuclease activity. This activated CRISPR effector protein will cleave both the target molecule and then non-specifically cleave the linker portion of the RNA construct.

The embodiments disclosed herein are directed to lateral flow detection devices that comprise SHERLOCK systems. The device may comprise a lateral flow substrate for detecting a SHERLOCK reaction. Substrates suitable for use in lateral flow assays are known in the art. These may include, but are not necessarily limited to membranes or pads made of cellulose and/or glass fiber, polyesters, nitrocellulose, or absorbent pads (*J Saudi Chem Soc* 19(6):689-705; 2015). The SHERLOCK system, i.e. one or more CRISPR systems and corresponding reporter constructs are added to the lateral flow substrate at a defined reagent portion of the lateral flow substrate, typically on one end of the lateral flow substrate. Reporting constructs used within the context of the present invention comprise a first molecule and a second molecule linked by an RNA or DNA linker. The lateral flow substrate further comprises a sample portion. The sample portion may be equivalent to, continuous with, or adjact to the reagent portion. The lateral flow strip further comprises a first capture line, typically a horizontal line running across the device, but other configurations are possible. The first capture region is proximate to and on the same end of the lateral flow substrate as the sample loading portion. A first binding agent that specifically binds the first molecule of the reporter construct is fixed or otherwise immobilized to the first capture region. The second capture region is located towards the opposite end of the lateral flow substrate from the first binding region. A second binding agent is fixed or otherwise immobilized at the second capture region. The second binding agent specifically binds the second molecule of the reporter construct, or the second binding agent may bind a detectable ligand. For example, the detectable ligand may be a particle, such as a colloidal particle, that when it aggregates can be detected visually. The particle may be modified with an antibody that specifically binds the second molecule on the reporter construct. If the reporter construct is not cleaved it will facilitate accumulation of the detectable ligand at the first binding region. If the reporter construct is cleaved the detectable ligand is released to flow to the second binding region. In such an embodiment, the second binding agent is an agent capable of specifically or non-specifically binding the detectable ligand on the antibody on the detectable ligand. Examples of suitable binding agents for such an embodiment include, but are not limited to, protein A and protein G.

Lateral support substrates may be located within a housing (see for example, "Rapid Lateral Flow Test Strips" *Merck Millipore* 2013). The housing may comprise at least one opening for loading samples and a second single opening or separate openings that allow for reading of detectable signal generated at the first and second capture regions.

The SHERLOCK system may be freeze-dried to the lateral flow substrate and packaged as a ready to use device, or the SHERLOCK system may be added to the reagent portion of the lateral flow substrate at the time of using the device. Samples to be screened are loaded at the sample loading portion of the lateral flow substrate. The samples must be liquid samples or samples dissolved in an appropriate solvent, usually aqueous. The liquid sample reconstitutes the SHERLOCK reagents such that a SHERLOCK reaction can occur. The liquid sample begins to flow from the sample portion of the substrate towards the first and second capture regions. Intact reporter construct is bound at the first capture region by binding between the first binding agent and the first molecule. Likewise, the detection agent will begin to collect at the first binding region by binding to the second molecule on the intact reporter construct. If target molecule(s) are present in the sample, the CRISPR effector protein collateral effect is activated. As activated CRISPR effector protein comes into contact with the bound reporter construct, the reporter constructs are cleaved, releasing the second molecule to flow further down the lateral flow substrate towards the second binding region. The released second molecule is then captured at the second capture region by binding to the second binding agent, where additional detection agent may also accumulate by binding to the second molecule. Accordingly, if the target molecule(s) is not present in the sample, a detectable signal will appear at the first capture region, and if the target molecule(s) is present in the sample, a detectable signal will appear at the location of the second capture region.

Specific binding-integrating molecules comprise any members of binding pairs that can be used in the present invention. Such binding pairs are known to those skilled in the art and include, but are not limited to, antibody-antigen pairs, enzyme-substrate pairs, receptor-ligand pairs, and streptavidin-biotin. In addition to such known binding pairs, novel binding pairs may be specifically designed. A characteristic of binding pairs is the binding between the two members of the binding pair.

Oligonucleotide Linkers having molecules on either end may comprise DNA if the CRISPR effector protein has DNA collateral activity (Cpf1 and C2c1) or RNA if the CRISPR effector protein has RNA collateral activity. Oligonucleotide linkers may be single stranded or double stranded, and in certain embodiments, they could contain both RNA and DNA regions. Oligonucleotide linkers may be of varying lengths, such as 5-10 nucleotides, 10-20 nucleotides, 20-50 nucleotides, or more.

In some embodiments, the polypeptide identifier elements include affinity tags, such as hemagglutinin (HA) tags, Myc tags, FLAG tags, V5 tags, chitin binding protein (CBP) tags, maltose-binding protein (MBP) tags, GST tags, poly-His tags, and fluorescent proteins (for example, green fluorescent protein (GFP), yellow fluorescent protein (YFP), cyan fluorescent protein (CFP), dsRed, mCherry, Kaede, Kindling, and derivatives thereof, FLAG tags, Myc tags, AU1 tags, T7 tags, OLLAS tags, Glu-Glu tags, VSV tags, or a combination thereof. Other Affinity tags are well known in the art. Such labels can be detected and/or isolated using methods known in the art (for example, by using specific binding agents, such as antibodies, that recognize a particular affinity tag). Such specific binding agents (for example, antibodies) can further contain, for example, detectable labels, such as isotope labels and/or nucleic acid barcodes such as those described herein.

For instance, a lateral flow strip allows for RNAse (e.g. Cas13a) detection by color. The RNA reporter is modified to have a first molecule (such as for instance FITC) attached to the 5' end and a second molecule (such as for instance biotin) attached to the 3' end (or vice versa). The lateral flow strip is designed to have two capture lines with anti-first molecule (e.g. anti-FITC) antibodies hybridized at the first line and anti-second molecule (e.g. anti-biotin) antibodies at the second downstream line. As the SHERLOCK reaction flows down the strip, uncleaved reporter will bind to anti-first molecule antibodies at the first capture line, while cleaved reporters will liberate the second molecule and allow second molecule binding at the second capture line. Second molecule sandwich antibodies, for instance conjugated to nanoparticles, such as gold nanoparticles, will bind any second molecule at the first or second line and result in a strong readout/signal (e.g. color). As more reporter is cleaved, more signal will accumulate at the second capture line and less signal will appear at the first line. In certain aspects, the invention relates to the use of a follow strip as described herein for detecting nucleic acids or polypeptides. In certain aspects, the invention relates to a method for detecting nucleic acids or polypeptides with a flow strip as defined herein, e.g. (lateral) flow tests or (lateral) flow immunochromatographic assays.

In certain example embodiments, a lateral flow device comprises a lateral flow substrate comprising a first end for application of a sample. The first region is loaded with a detectable ligand, such as those disclosed herein, for example a gold nanoparticle. The gold nanoparticle may be modified with a first antibody, such as an anti-FITC antibody. The first region also comprises a detection construct.

In one example embodiment, a RNA detection construct and a CRISPR effector system (a CRISPR effector protein and one or more guide sequences configured to bind to one or more target sequences) as disclosed herein. In one example embodiment, and for purposes of further illustration, the RNA construct may comprise a FAM molecule on a first end of the detection construction and a biotin on a second end of the detection construct. Upstream of the flow of solution from the first end of the lateral flow substrate is a first test band. The test band may comprise a biotin ligand. Accordingly, when the RNA detection construct is present it its initial state, i.e. in the absence of target, the FAM molecule on the first end will bind the anti-FITC antibody on the gold nanoparticle, and the biotin on the second end of the RNA construct will bind the biotin ligand allowing for the detectable ligand to accumulate at the first test, generating a detectable signal. Generation of a detectable signal at the first band indicate the absence of the target ligand. In the presence of target, the CRISPR effector complex forms and the CRISPR effector protein is activated resulting in cleavage of the RND detection construct. In the absence of intact RNA detection construct the colloidal gold will flow past the second strip. The lateral flow device may comprise a second band, upstream of the first band. The second band may comprise a molecule capable of binding the antibody-labeled colloidal gold molecule, for example an anti-rabbit antibody caple of binding a rabbit anti-FTIC antibody on the colloidal gold. Therefore, in the presence of one or more targets, the detectable ligand will accumulate at the second band, indicating the presence of the one or more targets in the sample.

Microbial Clustered Regularly Interspaced Short Palindromic Repeats (CRISPR) and CRISPR-associated (CRISPR-Cas) adaptive immune systems contain programmable endonucleases, such as Cas9 and Cpf1 (Shmakov et al., 2017; Zetsche et al., 2015). Although both Cas9 and Cpf1 target DNA, single effector RNA-guided RNases have been recently discovered (Shmakov et al., 2015) and characterized (Abudayyeh et al., 2016; Smargon et al., 2017), including C2c2, providing a platform for specific RNA sensing. RNA-guided RNases can be easily and conveniently reprogrammed using CRISPR RNA (crRNAs) to cleave target RNAs. Unlike the DNA endonucleases Cas9 and Cpf1, which cleave only its DNA target, RNA-guided RNases, like C2c2, remain active after cleaving their RNA target, leading to "collateral" cleavage of non-targeted RNAs in proximity (Abudayyeh et al., 2016). This crRNA-programmed collateral RNA cleavage activity presents the opportunity to use RNA-guided RNases to detect the presence of a specific RNA by triggering in vivo programmed cell death or in vitro nonspecific RNA degradation that can serve as a readout (Abudayyeh et al., 2016; East-Seletsky et al., 2016). Collateral activity has also been recognized in other CRISPR Cas enzymes [lead flag for me to provide cites for Cpf1 and C2c1 collateral activity].

Crispr Effector Proteins

In general, a CRISPR-Cas or CRISPR system as used in herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a C2c2 protein, a tracrRNA is not required. C2c2 has been described in Abudayyeh et al. (2016) "C2c2 is a single-component programmable RNA-guided RNA-targeting CRISPR effector"; Science; DOI: 10.1126/science.aaf5573; and Shmakov et al. (2015) "Discovery and Functional Characterization of Diverse Class 2 CRISPR-Cas Systems", Molecular Cell, DOI: dx.doi.org/10.1016/j.molcel.2015.10.008; which are incorporated herein in their entirety by reference. Cas13b has been described in Smargon et al. (2017) "Cas13b Is a Type VI-B CRISPR-Associated RNA-Guided RNases Differentially Regulated by Accessory Proteins Csx27 and Csx28," Molecular Cell. 65, 1-13; dx.doi.org/10.1016/j.molcel.2016.12.023., which is incorporated herein in its entirety by reference.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM. In certain embodiments, the CRISPR effector protein may recognize a 3' PAM which is 5'H, wherein H is A, C or U. In certain embodiments, the effector protein may be *Leptotrichia shahii* C2c2p, more preferably *Leptotrichia shahii* DSM 19757 C2c2, and the 3' PAM is a 5' H.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to an RNA polynucleotide being or comprising the target sequence. In other words, the target RNA may be an RNA polynucleotide or a part of an RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell.

The nucleic acid molecule encoding a CRISPR effector protein, in particular C2c2, is advantageously codon optimized CRISPR effector protein. An example of a codon optimized sequence, is in this instance a sequence optimized for expression in eukaryotes, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR effector protein is a codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell, in particular a C2c2 transgenic cell, in which one or more nucleic acids encoding one or more guide RNAs are provided or introduced operably connected in the cell with a regulatory element comprising a promoter of one or more genes of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas transgene can further comprise a Lox-Stop-polyA-Lox(LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus.

In certain aspects the invention involves vectors, e.g. for delivering or introducing in a cell Cas and/or RNA capable of guiding Cas to a target locus (i.e. guide RNA), but also for propagating these components (e.g. in prokaryotic cells). As used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety. Thus, the embodiments disclosed herein may also comprise transgenic cells comprising the CRISPR effector system. In certain example embodiments, the transgenic cell may function as an individual discrete volume. In other words, samples comprising a masking construct may be delivered to a cell, for example in a suitable delivery vesicle and if the target is present in the delivery vesicle the CRISPR effector is activated and a detectable signal generated.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (genome-engineering.org/taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner (see, e.g., nar.oxfordjournals.org/content/34/7/e53. short and nature.com/mt/journal/v16/n9/abs/mt2008144a.html). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters—especially as to the numbers of RNAs or guides discussed herein, without any undue experimentation.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter U6.

In some embodiments, one or more elements of a nucleic acid-targeting system is derived from a particular organism comprising an endogenous CRISPR RNA-targeting system. In certain example embodiments, the effector protein CRISPR RNA-targeting system comprises at least one HEPN domain, including but not limited to the HEPN domains described herein, HEPN domains known in the art, and domains recognized to be HEPN domains by comparison to consensus sequence motifs. Several such domains are provided herein. In one non-limiting example, a consensus sequence can be derived from the sequences of C2c2 or Cas13b orthologs provided herein. In certain example embodiments, the effector protein comprises a single HEPN domain. In certain other example embodiments, the effector protein comprises two HEPN domains.

In one example embodiment, the effector protein comprises one or more HEPN domains comprising an RxxxxH motif sequence. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed in U.S. Provisional Patent Application 62/432,240 entitled "Novel CRISPR Enzymes and Systems," U.S. Provisional Patent Application 62/471,710 entitled "Novel Type VI CRISPR Orthologs and Systems" filed on Mar. 15, 2017, and U.S. Provisional Patent Application entitled "Novel Type VI CRISPR Orthologs and Systems," filed on Apr. 12, 2017.

In an embodiment of the invention, a HEPN domain comprises at least one RxxxxH motif comprising the sequence of R{N/H/K}X1X2X3H (SEQ ID NO:351). In an embodiment of the invention, a HEPN domain comprises a RxxxxH motif comprising the sequence of R{N/H}X1X2X3H (SEQ ID NO:352). In an embodiment of the invention, a HEPN domain comprises the sequence of R{N/K}X1X2X3H (SEQ ID NO:353). In certain embodiments, X1 is R, S, D, E, Q, N, G, Y, or H. In certain embodiments, X2 is I, S, T, V, or L. In certain embodiments, X3 is L, F, N, Y, V, I, S, D, E, or A.

Additional effectors for use according to the invention can be identified by their proximity to cas1 genes, for example, though not limited to, within the region 20 kb from the start of the cas1 gene and 20 kb from the end of the cas1 gene. In certain embodiments, the effector protein comprises at least one HEPN domain and at least 500 amino acids, and wherein the C2c2 effector protein is naturally present in a prokaryotic genome within 20 kb upstream or downstream of a Cas gene or a CRISPR array. Non-limiting examples of Cas proteins include Cas1, Cas1B, Cas2, Cas3, Cas4, Cas5, Cash, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In certain example embodiments, the C2c2 effector protein is naturally present in a prokaryotic genome within 20 kb upstream or downstream of a Cas 1 gene. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related.

In particular embodiments, the Type VI RNA-targeting Cas enzyme is C2c2. In other example embodiments, the Type VI RNA-targeting Cas enzyme is Cas 13b. In particular embodiments, the homologue or orthologue of a Type VI protein such as C2c2 as referred to herein has a sequence homology or identity of at least 30%, or at least 40%, or at least 50%, or at least 60%, or at least 70%, or at least 80%, more preferably at least 85%, even more preferably at least 90%, such as for instance at least 95% with a Type VI protein such as C2c2 (e.g., based on the wild-type sequence of any of *Leptotrichia shahii* C2c2, *Lachnospiraceae bacterium* MA2020 C2c2, *Lachnospiraceae bacterium* NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, *Listeriaceae bacterium* (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2). In further embodiments, the homologue or orthologue of a Type VI protein such as C2c2 as referred to herein has a sequence identity of at least 30%, or at least 40%, or at least 50%, or at least 60%, or at least 70%, or at least 80%, more preferably at least 85%, even more preferably at least 90%, such as for instance at least 95% with the wild type C2c2 (e.g., based on the wild-type sequence of any of *Leptotrichia shahii* C2c2, *Lachnospiraceae bacterium* MA2020 C2c2, *Lachnospiraceae bacterium* NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, *Listeriaceae bacterium* (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2).

In certain other example embodiments, the CRISPR system effector protein is a C2c2 nuclease. The activity of C2c2 may depend on the presence of two HEPN domains. These have been shown to be RNase domains, i.e. nuclease (in particular an endonuclease) cutting RNA. C2c2 HEPN may also target DNA, or potentially DNA and/or RNA. On the basis that the HEPN domains of C2c2 are at least capable of binding to and, in their wild-type form, cutting RNA, then it is preferred that the C2c2 effector protein has RNase function. Regarding C2c2 CRISPR systems, reference is made to U.S. Provisional 62/351,662 filed on Jun. 17, 2016 and U.S. Provisional 62/376,377 filed on Aug. 17, 2016. Reference is also made to U.S. Provisional 62/351,803 filed on Jun. 17, 2016. Reference is also made to U.S. Provisional entitled "Novel Crispr Enzymes and Systems" filed Dec. 8, 2016 bearing Broad Institute No. 10035.PA4. Reference is further made to East-Seletsky et al. "Two distinct RNase activities of CRISPR-C2c2 enable guide-RNA processing and RNA detection" Nature doi:10/1038/nature19802 and Abudayyeh et al. "C2c2 is a single-component programmable RNA-guided RNA targeting CRISPR effector" bioRxiv doi:10.1101/054742.

RNase function in CRISPR systems is known, for example mRNA targeting has been reported for certain type III CRISPR-Cas systems (Hale et al., 2014, *Genes Dev*, vol. 28, 2432-2443; Hale et al., 2009, *Cell*, vol. 139, 945-956; Peng et al., 2015, *Nucleic acids research*, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector protein complex (see, Samai et al., 2015, Cell, vol. 151, 1164-1174). A CRISPR-Cas system, composition or method targeting RNA via the present effector proteins is thus provided.

In an embodiment, the Cas protein may be a C2c2 ortholog of an organism of a genus which includes but is not limited to *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. Species of organisms of such a genus can be as otherwise herein discussed.

Some methods of identifying orthologues of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genera herein mentioned or of species herein mentioned; advantageously the fragments are from CRISPR enzyme orthologs of different species.

In embodiments, the C2c2 protein as referred to herein also encompasses a functional variant of C2c2 or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type VI RNA-targeting effector proteins.

In an embodiment, nucleic acid molecule(s) encoding the C2c2 or an ortholog or homolog thereof, may be codon-optimized for expression in a eukaryotic cell. A eukaryote can be as herein discussed. Nucleic acid molecule(s) can be engineered or non-naturally occurring.

In an embodiment, the C2c2 or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the C2c2 or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the C2c2 or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In certain example embodiments, the C2c2 effector protein may be from an organism selected from the group consisting of; *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma*, and *Campylobacter*.

In certain embodiments, the effector protein may be a *Listeria* sp. C2c2p, preferably *Listeria seeligeria* C2c2p, more preferably *Listeria seeligeria* serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a *Leptotrichia* sp. C2c2p, preferably *Leptotrichia shahii* C2c2p, more preferably *Leptotrichia shahii* DSM 19757

C2c2p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

In certain example embodiments, the effector protein may be a *Leptotrichia* sp., *Leptotrichia wadei* F0279, or a *Listeria* sp., preferably *Listeria* newyorkensis FSL M6-0635.

In certain example embodiments, the C2c2 effector proteins of the invention include, without limitation, the following 21 ortholog species (including multiple CRISPR loci: *Leptotrichia shahii*; *Leptotrichia wadei* (Lw2); *Listeria seeligeri*; *Lachnospiraceae bacterium* MA2020; *Lachnospiraceae bacterium* NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; *Listeriaceae bacterium* FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; [*Eubacterium*] *rectale*; *Eubacteriaceae bacterium* CHKCI004; *Blautia* sp. Marseille-P2398; and *Leptotrichia* sp. oral taxon 879 str. F0557, Twelve (12) further non-limiting examples are: *Lachnospiraceae bacterium* NK4A144; *Chloroflexus aggregans*; *Demequina aurantiaca*; *Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae*; *Porphyromonadaceae bacterium* KH3CP3RA; *Listeria riparia*; and *Insolitispirillum peregrinum*.

In certain embodiments, the C2c2 protein according to the invention is or is derived from one of the orthologues as described in the table below, or is a chimeric protein of two or more of the orthologues as described in the table below, or is a mutant or variant of one of the orthologues as described in the table below (or a chimeric mutant or variant), including dead C2c2, split C2c2, destabilized C2c2, etc. as defined herein elsewhere, with or without fusion with a heterologous/functional domain.

In certain example embodiments, the C2c2 effector protein is selected from Table 1 below.

TABLE 1

| C2c2 orthologue | Code | Multi Letter |
| --- | --- | --- |
| *Leptotrichia shahii* | C2-2 | Lsh |
| *L. wadei* F0279 (Lw2) | C2-3 | Lw2 |
| *Listeria seeligeri* | C2-4 | Lse |
| *Lachnospiraceae bacterium* MA2020 | C2-5 | LbM |
| *Lachnospiraceae bacterium* NK4A179 | C2-6 | LbNK179 |
| *Clostridium aminophilum* DSM 10710 | C2-7 | Ca |
| *Carnobacterium gallinarum* DSM 4847 | C2-8 | Cg |
| *Carnobacterium gallinarum* DSM 4847 | C2-9 | Cg2 |
| *Paludibacter propionicigenes* WB4 | C2-10 | Pp |
| *Listeria weihenstephanensis* FSL R9-0317 | C2-11 | Lwei |
| *Listeriaceae bacterium* FSL M6-0635 | C2-12 | LbFSL |
| *Leptotrichia wadei* F0279 | C2-13 | Lw |
| *Rhodobacter capsulatus* SB 1003 | C2-14 | Rc |
| *Rhodobacter capsulatus* R121 | C2-15 | Rc |
| *Rhodobacter capsulatus* DE442 | C2-16 | Rc |
| *Leptotrichia buccalis* C-1013-b | C2-17 | LbuC2c2 |
| *Herbinix hemicellulosilytics* | C2-18 | HheC2c2 |
| *Eubacterium rectale* | C2-19 | EreC2c2 |
| *Eubacteriaceae bacterium* CHKC1004 | C2-20 | EbaC2c2 |
| *Blautia* sp. Marseille-P2398 | C2-21 | BsmC2c2 |
| *Leptotrichia* sp. oral taxon 879 str. F0557 | C2-22 | LspC2c2 |
| *Lachnospiraceae bacterium* NK4a144 | | |
| *Chloroflexus aggregans* | | |
| *Demequina aurantiaca* | | |
| *Thalassospira* sp. TSL5-1 | | |
| *Pseudobutyrivibrio* sp. OR37 | | |
| *Butyrivibrio* sp. YAB3001 | | |
| *Blautia* sp. Marseille-P2398 | | |
| *Leptotrichia* sp. Marseille-P300 | | |
| *Bacteroides ihuae* | | |
| *Porphyromonadaceae bacterium* KH3CP3RA | | |
| *Listeria riparia* | | |
| *Insolitispirillum peregrinum* | | |

The wild type protein sequences of the above species are listed in the Table 2 below. In certain embodiments, a nucleic acid sequence encoding the C2c2 protein is provided.

TABLE 2

| | | |
| --- | --- | --- |
| C2c2-2 | | *L. shahii* (Lsh) (SEQ. I.D. No. 1) |
| C2c2-2 | | *L. shahii* (Lsh) WP_018451595.1 |
| c2c2-3 | | *L. wadei* (Lw2) (SEQ. I.D. No. 2) |
| c2c2-4 | | *Listeria seeligeri* (SEQ. I.D. No. 3) |
| c2c2-5 | 1 | *Lachnospiraceae bacterium* MA2020 (SEQ. I.D. No. 4) |
| c2c2-6 | 2 | *Lachnospiraceae bacterium* NK4A179 (SEQ. I.D. No. 5) |
| c2c2-7 | 3 | *Clostridium aminophilum* DSM 10710 (SEQ. I.D. No. 6) |
| c2c2-8 | 5 | *Carnobacterium gallinarum* DSM 4847 (SEQ. I.D. No. 7) |
| c2c2-9 | 6 | *Carnobacterium gallinarum* DSM 4847 (SEQ. I.D. No. 8) |
| c2c2-10 | 7 | *Paludibacter propionicigenes* WB4 (SEQ. I.D. No. 9) |
| c2c2-11 | 9 | *Listeria weihenstephanensis* FSL R9-0317 (SEQ. I.D. No. 10) |
| c2c2-12 | 10 | *Listeriaceae bacterium* FSL M6-0635 = *Listeria newyorkensis* FSL M6-0635 (SEQ. I.D. No. 11) |

TABLE 2-continued

| | | |
|---|---|---|
| c2c2-13 | 12 | *Leptotrichia wadei* F0279 (SEQ. I.D. No. 12) |
| c2c2-14 | 15 | *Rhodobacter capsulatus* SB 1003 (SEQ. I.D. No. 13) |
| c2c2-15 | 16 | *Rhodobacter capsulatus* R121 (SEQ. I.D. No. 14) |
| c2c2-16 | 17 | *Rhodobacter capsulatus* DE442 (SEQ. I.D. No. 15) |
| LbuC2c2 (C2-17) | | *Leptotrichia buccalis* C-1013-b (SEQ ID NO: 354) |
| HheC2c2 (C2-18) | | *Herbinix hemicellulosilytica* (SEQ ID NO: 355) |
| EreC2c2 (C2-19) | | *Eubacterium rectale* (SEQ ID NO: 356) |
| EbaC2C2 (C2-20) | | *Eubacteriaceae bacterium* CHKCI004 (SEQ ID NO: 357) |
| C2c2 (C2-21) | | *Blautia* sp. Marseille-P2398 (SEQ ID NO: 358) |
| C2c2 (C2-22) | | *Leptotrichia* sp. Oral taxon 879 str. F0557 (SEQ ID NO: 359) |
| C2c2 NK4A144 (C2-23) | | *Lachnospiraceae bacterium* NK4A144 |
| C2c2 Chloro_agg (C2-24) | | RNA-binding protein 51 *Chloroflexus aggregans* (SEQ ID NO: 360) |
| C2c2 Dem_Aur (C2-25) | | *Demequina aurantiaca* (SEQ ID NO: 361) |
| C2c2 Thal_Sp_TSL5 (C2-26) | | *Thalassospira* sp. TSL5-1 (SEQ ID NO: 362) |
| C2c2 Pseudo_sp (C2-27) | | *Pseudobutyrivibrio* sp. OR37 (SEQ ID NO: 363) |
| C2c2_Buty_sp (C2-28) | | *Butyrivibrio* sp. YAB3001 |
| C2c2_*Blautia*_sp (C2-29) | | *Blautia* sp. Marseille-P2398 (SEQ ID NO: 364) |
| C2c2_Lepto_sp_Marseille (C2-30) | | *Leptotrichia* sp. Marseille-P3007 (SEQ ID NO: 365) |
| C2c2_*Bacteroides*_ihuae (C2-31) | | *Bacteroides* ihuae (SEQ ID NO: 366) |
| C2c2_*Porph*_*bacterium* (C2-32) | | *Porphyromonadaceae bacterium* KH3CP3RA |
| C2c2_*Listeria*_*riparia* (C2-33) | | *Listeria riparia* (SEQ ID NO: 367) |
| C2c2_insolitis_peregrinum (C2-34) | | Insolitispirillum peregrinum (SEQ ID NO: 368) |

In an embodiment of the invention, there is provided effector protein which comprises an amino acid sequence having at least 80% sequence homology to the wild-type sequence of any of *Leptotrichia shahii* C2c2, *Lachnospiraceae bacterium* MA2020 C2c2, *Lachnospiraceae bacterium* NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, *Listeriaceae bacterium* (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2.

In an embodiment of the invention, the effector protein comprises an amino acid sequence having at least 80% sequence homology to a Type VI effector protein consensus sequence including but not limited to a consensus sequence described herein.

According to the invention, a consensus sequence can be generated from multiple C2c2 orthologs, which can assist in locating conserved amino acid residues, and motifs, including but not limited to catalytic residues and HEPN motifs in C2c2 orthologs that mediate C2c2 function. One such consensus sequence, generated from the 33 orthologs mentioned above using Geneious alignment is:

(SEQ ID NO: 369)
MKISKVXXXVXKKXXXGKLXKXVNERNRXAKRLSNXLBKYIXXIDKIXKK

EXXKKFXAXEEITLKLNQXXXBXLXKAXXDLRKDNXYSXJKKILHNEDIN

XEEXELLINDXLEKLXKIESXKYSYQKXXXNYXMSVQEHSKKSIXRIXES

AKRNKEALDKFLKEYAXLDPRMEXLAKLRKLLELYFYFKNDXIXXEEEXN

VXXHKXLKENHPDFVEXXXNKENAELNXYAIEXKKJLKYYFPXKXAKNSN

DKIFEKQELKKXWIHQJENAVERILLXXGKVXYKLQXGYLAELWKIRINE

IFIKYIXVGKAVAXFALRNXXKBENDILGGKIXKKLNGITSFXYEKIKAE

EILQREXAVEVAFAANXLYAXDLXXIRXSILQFFGGASNWDXFLFFHFAT

SXISDKKWNAELIXXKKJGLVIREKLYSNNVAMFYSKDDLEKLLNXLXXF

XLRASQVPSFKKVYVRXBFPQNLLKKFNDEKDDEAYSAXYYLLKEIYYNX

FLPYFSANNXFFFXVKNLVLKANKDKFXXAFXDIREMNXGSPIEYLXXTQ

XNXXNEGRKKEEKEXDFIKFLLQIFXKGFDDYLKNNXXFILKFIPEPTEX

IEIXXELQAWYIVGKFLNARKXNLLGXFXSYLKLLDDIELRALRNENIKY

QSSNXEKEVLEXCLELIGLLSLDLNDYFBDEXDFAXYJGKXLDFEKKXMK

DLAELXPYDQNDGENPIVNRNIXLAKKYGTLNLLEKJCDKVSEKEIKEYY

-continued

ELKKEIEEYXXKGEELHEEWXQXKNRVEXRDILEYXEELXGQIINYNXLX

NKVLLYFQLGLHYLLLDILGRLVGYTGIWERDAXLYQIAAMYXNGLPEYI

XXKKNDKYKDGQIVGXKINXFKXDKKXLYNAGLELFENXNEHKNIXIRNY

IAHFNYLSKAESSLLXYSENLRXLFSYDRKLKNAVXKSLINILLRHGMVL

KFKFGTDKKSVXIRSXKKIXHLKSIAKKLYYPEVXVSKEYCKLVKXLLKY

K

In another non-limiting example, a sequence alignment tool to assist generation of a consensus sequence and identification of conserved residues is the MUSCLE alignment tool (www.ebi.ac.uk/Tools/msa/muscle/). For example, using MUSCLE, the following amino acid locations conserved among C2c2 orthologs can be identified in *Leptotrichia wadei* C2c2:K2; K5; V6; E301; L331; I335; N341; G351; K352; E375; L392; L396; D403; F446; I466; I470; R474 (HEPN); H475; H479 (HEPN), E508; P556; L561; I595; Y596; F600; Y669; I673; F681; L685; Y761; L676; L779; Y782; L836; D847; Y863; L869; I872; K879; I933; L954; I958; R961; Y965; E970; R971; D972; R1046 (HEPN), H1051 (HEPN), Y1075; D1076; K1078; K1080; I1083; I1090.

An exemplary sequence alignment of HEPN domains showing highly conserved residues is shown in FIG. 50.

In certain example embodiments, the RNA-targeting effector protein is a Type VI-B effector protein, such as Cas13b and Group 29 or Group 30 proteins. In certain example embodiments, the RNA-targeting effector protein comprises one or more HEPN domains. In certain example embodiments, the RNA-targeting effector protein comprises a C-terminal HEPN domain, an N-terminal HEPN domain, or both. Regarding example Type VI-B effector proteins that may be used in the context of this invention, reference is made to U.S. application Ser. No. 15/331,792 entitled "Novel CRISPR Enzymes and Systems" and filed Oct. 21, 2016, International Patent Application No. PCT/US2016/058302 entitled "Novel CRISPR Enzymes and Systems", and filed Oct. 21, 2016, and Smargon et al. "Cas13b is a Type VI-B CRISPR-associated RNA-Guided RNase differentially regulated by accessory proteins Csx27 and Csx28" Molecular Cell, 65, 1-13 (2017); dx.doi.org/10.1016/j.molcel.2016.12.023, and U.S. Provisional Application No. to be assigned, entitled "Novel Cas13b Orthologues CRISPR Enzymes and System" filed Mar. 15, 2017. In particular embodiments, the Cas13b enzyme is derived from *Bergeyella zoohelcum*. In certain other example embodiments, the effector protein is, or comprises an amino acid sequence having at least 80% sequence homology to any of the sequences listed in Table 3.

TABLE 3

| B-01 | *Bergeyella zoohelcum* |
|---|---|
| B-02 | *Prevotella intermedia* |
| B-03 | *Prevotella buccae* |
| B-04 | *Alistipes* sp. ZOR0009 |
| B-05 | *Prevotella* sp. MA2016 |
| B-06 | *Riemerella anatipestifer* |
| B-07 | *Prevotella aurantiaca* |
| B-08 | *Prevotella saccharolytica* |
| B-09 | *Prevotella intermedia* |
| B-10 | *Capnocytophaga canimorsus* |
| B-11 | *Porphyromonas gulae* |
| B-12 | *Prevotella* sp. P5-125 |
| B-13 | *Flavobacterium branchiophilum* |
| B-14 | *Porphyromonas gingivalis* |
| B-15 | *Prevotella intermedia* |

In certain example embodiments, the wild type sequence of the Cas13b orthologue is found in Table 4a or 4b below.

TABLE 4a

| | |
|---|---|
| *Bergeyella zoohelcum* (SEQ ID NO: 370) | 1 |
| *Prevotella intermedia* (SEQ ID NO: 371) | 2 |
| *Prevotella buccae* (SEQ ID NO: 372) | 3 |
| *Porphyromonas gingivalis* (SEQ ID NO: 373) | 4 |
| *Bacteroides pyogenes* (SEQ ID NO: 374) | 5 |
| *Alistipes* sp. ZOR0009 (SEQ ID NO: 375) | 6 |
| *Prevotella* sp. MA2016 (SEQ ID NO: 376) | 7a |
| *Prevotella* sp. MA2016 (SEQ ID NO: 377) | 7b |
| *Riemerella anatipestifer* (SEQ ID NO: 378) | 8 |
| *Prevotella aurantiaca* (SEQ ID NO: 379) | 9 |
| *Prevotella saccharolytica* (SEQ ID NO: 380) | 10 |
| HMPREF9712_03108 [*Myroides odoratimimus* CCUG 10230] (SEQ ID NO: 381) | 11 |
| *Prevotella intermedia* (SEQ ID NO: 382) | 12 |
| *Capnocytophaga canimorsus* (SEQ ID NO: 383) | 13 |
| *Porphyromonas gulae* (SEQ ID NO: 878) | 14 |
| *Prevotella* sp. P5-125 (SEQ ID NO: 384) | 15 |

TABLE 4a-continued

| | |
|---|---|
| *Flavobacterium branchiophilum* (SEQ ID NO: 385) | 16 |
| *Myroides odoratimimus* (SEQ ID NO: 386) | 17 |
| *Flavobacterium columnare* (SEQ ID NO: 387) | 18 |
| *Porphyromonas gingivalis* (SEQ ID NO: 388) | 19 |
| *Porphyromonas* sp. COT-052 OH4946 (SEQ ID NO: 389) | 20 |
| *Prevotella intermedia* (SEQ ID NO: 390) | 21 |
| PIN17_0200 [*Prevotella intermedia* 17] (SEQ ID NO: 391) | AFJ07523 |
| *Prevotella intermedia* (SEQ ID NO: 392) | BAU18623 |
| HMPREF6485_0083 [*Prevotella buccae* ATCC 33574] (SEQ ID NO: 393) | EFU31981 |
| HMPREF9144_1146 [*Prevotella pallens* ATCC 700821] (SEQ ID NO: 394) | EGQ18444 |
| HMPREF9714_02132 [*Myroides odoratimimus* CCUG 12901] (SEQ ID NO: 395) | EHO08761 |
| HMPREF9711_00870 [*Myroides odomtimimus* CCUG 3837] (SEQ ID NO: 396) | EKB06014 |
| HMPREF9699_02005 [*Bergeyella zoohelcum* ATCC 43767] | EKB54193 |
| HMPREF9151_01387 [*Prevotella saccharolytica* F0055] | EKY00089 |
| A343_1752 [*Porphyromonas gingivalis* JCVI SC001] | EOA10535 |
| HMPREF1981_03090 [*Bacteroides pyogenes* F0041] | ERI81700 |
| HMPREF1553_02065 [*Porphyromonas gingivalis* F0568] | ERJ65637 |
| HMPREF1988_01768 [*Porphyromonas gingivalis* F0185] | ERJ81987 |
| HMPREF1990_01800 [*Porphyromonas gingivalis* W4087] | ERJ87335 |
| M573_117042 [*Prevotella intermedia* ZT] | KJJ86756 |
| A2033_10205 [*Bacteroidetes bacterium* GWA2_31_9] (SEQ ID NO: 397) | OFX18020.1 |
| SAMN05421542_0666 [*Chryseobacterium jejuense*] (SEQ ID NO: 398) | SDI27289.1 |
| SAMN05444360_11366 [*Chryseobacterium carnipullorum*] (SEQ ID NO: 399) | SHM52812.1 |
| SAMN05421786_1011119 [*Chryseobacterium ureilyticum*] (SEQ ID NO: 400) | SIS70481.1 |
| *Prevotella buccae* | WP_004343581 |
| *Porphyromonas gingivalis* | WP_005873511 |
| *Porphyromonas gingivalis* | WP_005874195 |
| *Prevotella pallens* | WP_006044833 |
| *Myroides odoratimimus* | WP_006261414 |
| *Myroides odoratimimus* | WP_006265509 |
| *Prevotella* sp. MSX73 | WP_007412163 |
| *Porphyromonas gingivalis* | WP_012458414 |
| *Paludibacter propionicigenes* | WP_013446107 |
| *Porphyromonas gingivalis* | WP_013816155 |
| *Flavobacterium columnare* | WP_014165541 |
| *Psychroflexus torquis* | WP_015024765 |
| *Riemerella anatipestifer* | WP_015345620 |
| *Prevotella pleuritidis* | WP_021584635 |
| *Porphyromonas gingivalis* | WP_021663197 |
| *Porphyromonas gingivalis* | WP_021665475 |
| *Porphyromonas gingivalis* | WP_021677657 |
| *Porphyromonas gingivalis* | WP_021680012 |
| *Porphyromonas gingivalis* | WP_023846767 |
| *Prevotella falsenii* | WP_036884929 |
| *Prevotella pleuritidis* | WP_036931485 |
| [*Porphyromonas gingivalis* | WP_039417390 |
| *Porphyromonas gulae* | WP_039418912 |
| *Porphyromonas gulae* | WP_039419792 |
| *Porphyromonas gulae* | WP_039426176 |
| *Porphyromonas gulae* | WP_039431778 |
| *Porphyromonas gulae* | WP_039437199 |
| *Porphyromonas gulae* | WP_039442171 |
| *Porphyromonas gulae* | WP_039445055 |
| *Capnocytophaga cynodegmi* | WP_041989581 |
| *Prevotella* sp. P5-119 | WP_042518169 |
| *Prevotella* sp. P4-76 | WP_044072147 |
| *Prevotella* sp. P5-60 | WP_044074780 |
| *Phaeodactylibacter xiamenensis* | WP_044218239 |
| *Flavobacterium* sp. 316 | WP_045968377 |
| *Porphyromonas gulae* | WP_046201018 |
| WP_047431796 | *Chryseobacterium* sp. YR477 |
| *Riemerella anatipestifer* | WP_049354263 |
| *Porphyromonas gingivalis* | WP_052912312 |
| *Porphyromonas gingivalis* | WP_058019250 |

TABLE 4a-continued

| | |
|---|---|
| Flavobacterium columnare | WP_060381855 |
| Porphyromonas gingivalis | WP_061156470 |
| Porphyromonas gingivalis | WP_061156637 |
| Riemerella anatipestifer | WP_061710138 |
| Flavobacterium columnare | WP_063744070 |
| Riemerella anatipestifer | WP_064970887 |
| Sinomicrobium oceani | WP_072319476.1 |
| Reichenbachiella agariperforans | WP_073124441.1 |

TABLE 4b

| Name or Accession No. |
|---|
| WP_015345620 |
| WP_049354263 |
| WP_061710138 |
| 6 (SEQ ID NO: 401) |
| SIS70481.1 |
| (SEQ ID NO: 402) |
| 15 (SEQ ID NO: 403) |
| WP_042518169 |
| WP_044072147 |
| WP_044074780 |
| 8_(modified) (SEQ ID NO: 404) |
| WP_064970887 |
| 5(SEQ ID NO: 405) |
| ERI81700 |
| WP_036931485 |
| 19 (SEQ ID NO: 406) |
| WP_012458414 |
| WP_013816155 |
| WP_039417390 |
| WP_039419792 |
| WP_039426176 |
| WP_039437199 |
| WP_061156470 |
| 12 (SEQ ID NO: 407) |
| 9 (SEQ ID NO: 408) |
| EGQ18444 |
| (SEQ ID NO: 409) |
| KJJ86756 (SEQ ID NO: 410) |
| WP_006044833 |
| 2 (SEQ ID NO: 411) |
| 3 (SEQ ID NO: 412) |
| EFU31981 |
| WP_004343581 |
| WP_007412163 |
| WP_044218239 |
| 21 (SEQ ID NO: 413) |
| BAU18623 (SEQ ID NO: 414) |
| WP_036884929 |
| WP_073124441.1 |
| AFJ07523 |
| 4 (SEQ ID NO: 415) |
| ERJ65637 |
| ERJ81987 |
| ERJ87335 |
| WP_005873511 |
| WP_021663197 |
| WP_021665475 |
| WP_021677657 |
| WP_021680012 |
| WP_023846767 |
| WP_039445055 |
| WP_061156637 |
| WP_021584635 |
| WPO15024765 |
| WP_047431796 |
| WP_072319476.1 |
| 16 (SEQ ID NO: 416) |
| EKY00089 |
| 10 (SEQ ID NO: 417) |
| WP_013446107 |
| WP_045968377 |
| SHM52812.1 |
| (SEQ ID NO: 418) |
| EH008761 |
| EKB06014 |
| WP_006261414 |
| WP_006265509 |
| 11 (SEQ ID NO: 419) |
| 17 (SEQ ID NO: 420) |
| OFX18020.1 (SEQ ID NO: 421) |
| SDI27289.1 (SEQ ID NO: 422) |
| WP_039442171 |
| 14 (SEQ ID NO: 423) |
| 20 (SEQ ID NO: 424) |
| EOA10535 |
| WP_005874195 |
| WP_039418912 |
| WP_039431778 |
| WP_046201018 |
| WP_052912312 |
| WP_058019250 |
| WP_014165541 |
| 13 (SEQ ID NO: 425) |
| WP_060381855 |
| WP_063744070 |
| 18 (SEQ ID NO: 426) |
| WP_041989581 |
| 1 (SEQ ID NO: 427) |
| EKB54193 |
| 7_(modified) (SEQ ID NO: 428) |
| 7_(modified)_-_residues_only (SEQ ID NO: 429) |

In certain example embodiments, the RNA-targeting effector protein is a Cas13c effector protein as disclosed in U.S. Provisional Patent Application No. 62/525,165 filed Jun. 26, 2017, and PCT Application No. US 2017/047193 filed Aug. 16, 2017. Example wild type orthologue sequences of Cas13c are provided in Table 5 below.

TABLE 5

| Name |
|---|
| EHO19081 |
| WP_094899336 |
| WP_040490876 |
| WP_047396607 |
| WP_035935671 |
| WP_035906563 |
| WP_042678931 |
| WP_062627846 |
| WP_005959231 |
| WP_027128616 |
| WP_062624740 |
| WP_096402050 |

Cas12 Proteins

In certain example embodiments, the assays may comprise multiple Cas12 orthologs or one or more orthologs in combination with one or more Cas13 orthologs. In certain example embodiments, the Cas12 orthologs are Cpf1 orthologs. In certain other example embodiments, the Cas12 orthologs are C2c1 orthologs.

Cpf1 Orthologs

The present invention encompasses the use of a Cpf1 effector protein, derived from a Cpf1 locus denoted as subtype V-A. Herein such effector proteins are also referred to as "Cpf1p", e.g., a Cpf1 protein (and such effector protein or Cpf1 protein or protein derived from a Cpf1 locus is also called "CRISPR enzyme"). Presently, the subtype V-A loci encompasses cas1, cas2, a distinct gene denoted cpf1 and a CRISPR array. Cpf1 (CRISPR-associated protein Cpf1, subtype PREFRAN) is a large protein (about 1300 amino acids) that contains a RuvC-like nuclease domain homologous to the corresponding domain of Cas9 along with a counterpart to the characteristic arginine-rich cluster of Cas9. However, Cpf1 lacks the HNH nuclease domain that is present in all Cas9 proteins, and the RuvC-like domain is contiguous in the Cpf1 sequence, in contrast to Cas9 where it contains long inserts including the HNH domain. Accordingly, in particular embodiments, the CRISPR-Cas enzyme comprises only a RuvC-like nuclease domain.

The programmability, specificity, and collateral activity of the RNA-guided Cpf1 also make it an ideal switchable nuclease for non-specific cleavage of nucleic acids. In one embodiment, a Cpf1 system is engineered to provide and take advantage of collateral non-specific cleavage of RNA. In another embodiment, a Cpf1 system is engineered to provide and take advantage of collateral non-specific cleavage of ssDNA. Accordingly, engineered Cpf1 systems provide platforms for nucleic acid detection and transcriptome manipulation. Cpf1 is developed for use as a mammalian transcript knockdown and binding tool. Cpf1 is capable of robust collateral cleavage of RNA and ssDNA when activated by sequence-specific targeted DNA binding.

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4):359-66. doi: 10.1002/pro.2225.). See also Shmakov et al. (2015) for application in the field of CRISPR-Cas loci. Homologous proteins may but need not be structurally related, or are only partially structurally related.

The Cpf1 gene is found in several diverse bacterial genomes, typically in the same locus with cas1, cas2, and cas4 genes and a CRISPR cassette (for example, FNFX1_1431-FNFX1_1428 of *Francisella* cf. *novicida* Fx1). Thus, the layout of this putative novel CRISPR-Cas system appears to be similar to that of type II-B. Furthermore, similar to Cas9, the Cpf1 protein contains a readily identifiable C-terminal region that is homologous to the transposon ORF-B and includes an active RuvC-like nuclease, an arginine-rich region, and a Zn finger (absent in Cas9). However, unlike Cas9, Cpf1 is also present in several genomes without a CRISPR-Cas context and its relatively high similarity with ORF-B suggests that it might be a transposon component. It was suggested that if this was a genuine CRISPR-Cas system and Cpf1 is a functional analog of Cas9 it would be a novel CRISPR-Cas type, namely type V (See Annotation and Classification of CRISPR-Cas Systems. Makarova K S, Koonin E V. Methods Mol Biol. 2015; 1311:47-75).

However, as described herein, Cpf1 is denoted to be in subtype V-A to distinguish it from C2c1p which does not have an identical domain structure and is hence denoted to be in subtype V-B.

In particular embodiments, the effector protein is a Cpf1 effector protein from an organism from a genus comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus*.

In further particular embodiments, the Cpf1 effector protein is from an organism selected from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii*.

The effector protein may comprise a chimeric effector protein comprising a first fragment from a first effector protein (e.g., a Cpf1) ortholog and a second fragment from a second effector (e.g., a Cpf1) protein ortholog, and wherein the first and second effector protein orthologs are different. At least one of the first and second effector protein (e.g., a Cpf1) orthologs may comprise an effector protein (e.g., a Cpf1) from an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus*; e.g., a chimeric effector protein comprising a first fragment and a second fragment wherein each of the first and second fragments is selected from a Cpf1 of an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus* wherein the first and second fragments are not from the same bacteria; for instance a chimeric effector protein comprising a first fragment and a second fragment wherein each of the first and second fragments is selected from a Cpf1 of *S. mutans, S. agalactiae, S. equisimilis, S. sanguinis, S. pneumonia; C. jejuni, C. coli; N. salsuginis, N. tergarcus; S. auricularis, S.*

*carnosus; N. meningitides, N. gonorrhoeae; L. monocytogenes, L. ivanovii; C. botulinum, C. difficile, C. tetani, C. sordellii; Francisella tularensis* 1, *Prevotella albensis, Lachnospiraceae* bacterium MC2017 1, *Butyrivibrio proteoclasticus,* Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae* bacterium MA2020, *Candidatus Methanoplasma termitum, Eubacterium eligens, Moraxella bovoculi* 237, *Leptospira inadai, Lachnospiraceae* bacterium ND2006, *Porphyromonas crevioricanis* 3, *Prevotella disiens* and *Porphyromonas macacae,* wherein the first and second fragments are not from the same bacteria.

In a more preferred embodiment, the Cpf1p is derived from a bacterial species selected from *Francisella tularensis* 1, *Prevotella albensis, Lachnospiraceae* bacterium MC2017 1, *Butyrivibrio proteoclasticus,* Peregrinibacteria bacterium GW2011_GWA2_33_10, Parcubacteria bacterium GW2011_GWC2_44_17, *Smithella* sp. SCADC, *Acidaminococcus* sp. BV3L6, *Lachnospiraceae* bacterium MA2020, *Candidatus Methanoplasma termitum, Eubacterium eligens, Moraxella bovoculi* 237, *Leptospira inadai, Lachnospiraceae* bacterium ND2006, *Porphyromonas crevioricanis* 3, *Prevotella disiens* and *Porphyromonas macacae.* In certain embodiments, the Cpf1p is derived from a bacterial species selected from *Acidaminococcus* sp. BV3L6, *Lachnospiraceae* bacterium MA2020. In certain embodiments, the effector protein is derived from a subspecies of *Francisella tularensis* 1, including but not limited to *Francisella tularensis* subsp. *Novicida.*

In some embodiments, the Cpf1p is derived from an organism from the genus of *Eubacterium.* In some embodiments, the CRISPR effector protein is a Cpf1 protein derived from an organism from the bacterial species of *Eubacterium rectale.* In some embodiments, the amino acid sequence of the Cpf1 effector protein corresponds to NCBI Reference Sequence WP_055225123.1, NCBI Reference Sequence WP_055237260.1, NCBI Reference Sequence WP_055272206.1, or GenBank ID OLA16049.1. In some embodiments, the Cpf1 effector protein has a sequence homology or sequence identity of at least 60%, more particularly at least 70, such as at least 80%, more preferably at least 85%, even more preferably at least 90%, such as for instance at least 95%, with NCBI Reference Sequence WP_055225123.1, NCBI Reference Sequence WP_055237260.1, NCBI Reference Sequence WP_055272206.1, or GenBank ID OLA16049.1. The skilled person will understand that this includes truncated forms of the Cpf1 protein whereby the sequence identity is determined over the length of the truncated form. In some embodiments, the Cpf1 effector recognizes the PAM sequence of TTTN or CTTN.

In particular embodiments, the homologue or orthologue of Cpf1 as referred to herein has a sequence homology or identity of at least 80%, more preferably at least 85%, even more preferably at least 90%, such as for instance at least 95% with Cpf1. In further embodiments, the homologue or orthologue of Cpf1 as referred to herein has a sequence identity of at least 80%, more preferably at least 85%, even more preferably at least 90%, such as for instance at least 95% with the wild type Cpf1. Where the Cpf1 has one or more mutations (mutated), the homologue or orthologue of said Cpf1 as referred to herein has a sequence identity of at least 80%, more preferably at least 85%, even more preferably at least 90%, such as for instance at least 95% with the mutated Cpf1.

In an embodiment, the Cpf1 protein may be an ortholog of an organism of a genus which includes, but is not limited to *Acidaminococcus* sp, *Lachnospiraceae* bacterium or *Moraxella bovoculi;* in particular embodiments, the type V Cas protein may be an ortholog of an organism of a species which includes, but is not limited to *Acidaminococcus* sp. BV3L6; *Lachnospiraceae* bacterium ND2006 (LbCpf1) or *Moraxella bovoculi* 237. In particular embodiments, the homologue or orthologue of Cpf1 as referred to herein has a sequence homology or identity of at least 80%, more preferably at least 85%, even more preferably at least 90%, such as for instance at least 95% with one or more of the Cpf1 sequences disclosed herein. In further embodiments, the homologue or orthologue of Cpf as referred to herein has a sequence identity of at least 80%, more preferably at least 85%, even more preferably at least 90%, such as for instance at least 95% with the wild type FnCpf1, AsCpf1 or LbCpf1.

In particular embodiments, the Cpf1 protein of the invention has a sequence homology or identity of at least 60%, more particularly at least 70, such as at least 80%, more preferably at least 85%, even more preferably at least 90%, such as for instance at least 95% with FnCpf1, AsCpf1 or LbCpf1. In further embodiments, the Cpf1 protein as referred to herein has a sequence identity of at least 60%, such as at least 70%, more particularly at least 80%, more preferably at least 85%, even more preferably at least 90%, such as for instance at least 95% with the wild type AsCpf1 or LbCpf1. In particular embodiments, the Cpf1 protein of the present invention has less than 60% sequence identity with FnCpf1. The skilled person will understand that this includes truncated forms of the Cpf1 protein whereby the sequence identity is determined over the length of the truncated form.

C2c1 Orthologs

The present invention encompasses the use of a C2c1 effector proteins, derived from a C2c1 locus denoted as subtype V-B. Herein such effector proteins are also referred to as "C2c1p", e.g., a C2c1 protein (and such effector protein or C2c1 protein or protein derived from a C2c1 locus is also called "CRISPR enzyme"). Presently, the subtype V-B loci encompasses cas1-Cas4 fusion, cas2, a distinct gene denoted C2c1 and a CRISPR array. C2c1 (CRISPR-associated protein C2c1) is a large protein (about 1100-1300 amino acids) that contains a RuvC-like nuclease domain homologous to the corresponding domain of Cas9 along with a counterpart to the characteristic arginine-rich cluster of Cas9. However, C2c1 lacks the HNH nuclease domain that is present in all Cas9 proteins, and the RuvC-like domain is contiguous in the C2c1 sequence, in contrast to Cas9 where it contains long inserts including the HNH domain. Accordingly, in particular embodiments, the CRISPR-Cas enzyme comprises only a RuvC-like nuclease domain.

C2c1 (also known as Cas12b) proteins are RNA guided nucleases. Its cleavage relies on a tracr RNA to recruit a guide RNA comprising a guide sequence and a direct repeat, where the guide sequence hybridizes with the target nucleotide sequence to form a DNA/RNA heteroduplex. Based on current studies, C2c1 nuclease activity also requires relies on recognition of PAM sequence. C2c1 PAM sequences are T-rich sequences. In some embodiments, the PAM sequence is 5' TTN 3' or 5' ATTN 3', wherein N is any nucleotide. In a particular embodiment, the PAM sequence is 5' TTC 3'. In a particular embodiment, the PAM is in the sequence of *Plasmodium falciparum.*

C2c1 creates a staggered cut at the target locus, with a 5' overhang, or a "sticky end" at the PAM distal side of the target sequence. In some embodiments, the 5' overhang is 7 nt. See Lewis and Ke, Mol Cell. 2017 Feb. 2; 65(3):377-379.

The invention provides C2c1 (Type V-B; Cas12b) effector proteins and orthologues. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of Homologous proteins may but need not be structurally related, or are only partially structurally related. An "orthologue" of a protein as used herein is a protein of a different species which performs the same or a similar function as the protein it is an orthologue of Orthologous proteins may but need not be structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4):359-66. doi: 10.1002/pro.2225.). See also Shmakov et al. (2015) for application in the field of CRISPR-Cas loci. Homologous proteins may but need not be structurally related, or are only partially structurally related.

The C2c1 gene is found in several diverse bacterial genomes, typically in the same locus with cas1, cas2, and cas4 genes and a CRISPR cassette. Thus, the layout of this putative novel CRISPR-Cas system appears to be similar to that of type II-B. Furthermore, similar to Cas9, the C2c1 protein contains an active RuvC-like nuclease, an arginine-rich region, and a Zn finger (absent in Cas9).

In particular embodiments, the effector protein is a C2c1 effector protein from an organism from a genus comprising *Alicyclobacillus, Desulfovibrio, Desulfonatronum, Opitutaceae, Tuberibacillus, Bacillus, Brevibacillus, Candidatus, Desulfatirhabdium, Citrobacter, Elusimicrobia, Methylobacterium, Omnitrophica, Phycisphaerae, Planctomycetes, Spirochaetes*, and *Verrucomicrobiaceae*.

In further particular embodiments, the C2c1 effector protein is from a species selected from *Alicyclobacillus acidoterrestris* (e.g., ATCC 49025), *Alicyclobacillus contaminans* (e.g., DSM 17975), *Alicyclobacillus macrosporangiidus* (e.g. DSM 17980), *Bacillus hisashii* strain C4, *Candidatus Lindowbacteria bacterium* RIFCSPLOWO2, *Desulfovibrio inopinatus* (e.g., DSM 10711), *Desulfonatronum thiodismutans* (e.g., strain MLF-1), *Elusimicrobia bacterium* RIFOXYA12, *Omnitrophica* WOR_2 *bacterium* RIFCSPHIGHO2, *Opitutaceae bacterium* TAV5, *Phycisphaerae bacterium* ST-NAGAB-D1, *Planctomycetes bacterium* RBG_13_46_10, *Spirochaetes bacterium* GWB1_27_13, *Verrucomicrobiaceae bacterium* UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060).

The effector protein may comprise a chimeric effector protein comprising a first fragment from a first effector protein (e.g., a C2c1) ortholog and a second fragment from a second effector (e.g., a C2c1) protein ortholog, and wherein the first and second effector protein orthologs are different. At least one of the first and second effector protein (e.g., a C2c1) orthologs may comprise an effector protein (e.g., a C2c1) from an organism comprising *Alicyclobacillus, Desulfovibrio, Desulfonatronum, Opitutaceae, Tuberibacillus, Bacillus, Brevibacillus, Candidatus, Desulfatirhabdium, Elusimicrobia, Citrobacter, Methylobacterium, Omnitrophicai, Phycisphaerae, Planctomycetes, Spirochaetes*, and *Verrucomicrobiaceae*; e.g., a chimeric effector protein comprising a first fragment and a second fragment wherein each of the first and second fragments is selected from a C2c1 of an organism comprising *Alicyclobacillus, Desulfovibrio, Desulfonatronum, Opitutaceae, Tuberibacillus, Bacillus, Brevibacillus, Candidatus, Desulfatirhabdium, Elusimicrobia, Citrobacter, Methylobacterium, Omnitrophicai, Phycisphaerae, Planctomycetes, Spirochaetes*, and *Verrucomicrobiaceae* wherein the first and second fragments are not from the same bacteria; for instance a chimeric effector protein comprising a first fragment and a second fragment wherein each of the first and second fragments is selected from a C2c1 of *Alicyclobacillus acidoterrestris* (e.g., ATCC 49025), *Alicyclobacillus contaminans* (e.g., DSM 17975), *Alicyclobacillus macrosporangiidus* (e.g. DSM 17980), *Bacillus hisashii* strain C4, *Candidatus Lindowbacteria bacterium* RIFCSPLOWO2, *Desulfovibrio inopinatus* (e.g., DSM 10711), *Desulfonatronum thiodismutans* (e.g., strain MLF-1), *Elusimicrobia bacterium* RIFOXYA12, *Omnitrophica* WOR2 *bacterium* RIFCSPHIGHO2, *Opitutaceae bacterium* TAV5, *Phycisphaerae bacterium* ST-NAGAB-D1, *Planctomycetes bacterium* RBG_13_46_10, *Spirochaetes bacterium* GWB1_27_13, *Verrucomicrobiaceae bacterium* UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060), wherein the first and second fragments are not from the same bacteria.

In a more preferred embodiment, the C2c1p is derived from a bacterial species selected from *Alicyclobacillus acidoterrestris* (e.g., ATCC 49025), *Alicyclobacillus contaminans* (e.g., DSM 17975), *Alicyclobacillus macrosporangiidus* (e.g. DSM 17980), *Bacillus hisashii* strain C4, *Candidatus Lindowbacteria bacterium* RIFCSPLOWO2, *Desulfovibrio inopinatus* (e.g., DSM 10711), *Desulfonatronum thiodismutans* (e.g., strain MLF-1), *Elusimicrobia bacterium* RIFOXYA12, *Omnitrophica* WOR2 *bacterium* RIFCSPHIGHO2, *Opitutaceae bacterium* TAV5, *Phycisphaerae bacterium* ST-NAGAB-D1, *Planctomycetes bacterium* RBG_13_46_10, *Spirochaetes bacterium* GWB1_27_13, *Verrucomicrobiaceae bacterium* UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060). In certain embodiments, the C2c1p is derived from a bacterial species selected from *Alicyclobacillus acidoterrestris* (e.g., ATCC 49025), *Alicyclobacillus contaminans* (e.g., DSM 17975).

In particular embodiments, the homologue or orthologue of C2c1 as referred to herein has a sequence homology or identity of at least 80%, more preferably at least 85%, even more preferably at least 90%, such as for instance at least 95% with C2c1. In further embodiments, the homologue or orthologue of C2c1 as referred to herein has a sequence identity of at least 80%, more preferably at least 85%, even more preferably at least 90%, such as for instance at least 95% with the wild type C2c1. Where the C2c1 has one or more mutations (mutated), the homologue or orthologue of said C2c1 as referred to herein has a sequence identity of at least 80%, more preferably at least 85%, even more preferably at least 90%, such as for instance at least 95% with the mutated C2c1.

In an embodiment, the C2c1 protein may be an ortholog of an organism of a genus which includes, but is not limited to *Alicyclobacillus, Desulfovibrio, Desulfonatronum, Opitutaceae, Tuberibacillus, Bacillus, Brevibacillus, Candidatus, Desulfatirhabdium, Elusimicrobia, Citrobacter, Methylobacterium, Omnitrophicai, Phycisphaerae, Planctomycetes, Spirochaetes,* and *Verrucomicrobiaceae*; in particular embodiments, the type V Cas protein may be an ortholog of an organism of a species which includes, but is not limited to *Alicyclobacillus acidoterrestris* (e.g., ATCC 49025), *Alicyclobacillus contaminans* (e.g., DSM 17975), *Alicyclobacillus macrosporangiidus* (e.g. DSM 17980), *Bacillus hisashii* strain C4, *Candidatus Lindowbacteria bacterium* RIFCSPLOWO2, *Desulfovibrio inopinatus* (e.g., DSM 10711), *Desulfonatronum thiodismutans* (e.g., strain MLF-1), *Elusimicrobia bacterium* RIFOXYA12, *Omnitrophica* WOR_2 *bacterium* RIFCSPHIGHO2, *Opitutaceae bacterium* TAV5, *Phycisphaerae bacterium* ST-NAGAB-D1, *Planctomycetes bacterium* RBG_13_46_10, *Spirochaetes bacterium* GWB1_27_13, *Verrucomicrobiaceae bacterium* UBA2429, *Tuberibacillus calidus* (e.g., DSM 17572), *Bacillus thermoamylovorans* (e.g., strain B4166), *Brevibacillus* sp. CF112, *Bacillus* sp. NSP2.1, *Desulfatirhabdium butyrativorans* (e.g., DSM 18734), *Alicyclobacillus herbarius* (e.g., DSM 13609), *Citrobacter freundii* (e.g., ATCC 8090), *Brevibacillus agri* (e.g., BAB-2500), *Methylobacterium nodulans* (e.g., ORS 2060), In particular embodiments, the homologue or orthologue of C2c1 as referred to herein has a sequence homology or identity of at least 80%, more preferably at least 85%, even more preferably at least 90%, such as for instance at least 95% with one or more of the C2c1 sequences disclosed herein. In further embodiments, the homologue or orthologue of C2c1 as referred to herein has a sequence identity of at least 80%, more preferably at least 85%, even more preferably at least 90%, such as for instance at least 95% with the wild type AacC2c1 or BthC2c1.

In particular embodiments, the C2c1 protein of the invention has a sequence homology or identity of at least 60%, more particularly at least 70, such as at least 80%, more preferably at least 85%, even more preferably at least 90%, such as for instance at least 95% with AacC2c1 or BthC2c1. In further embodiments, the C2c1 protein as referred to herein has a sequence identity of at least 60%, such as at least 70%, more particularly at least 80%, more preferably at least 85%, even more preferably at least 90%, such as for instance at least 95% with the wild type AacC2c1. In particular embodiments, the C2c1 protein of the present invention has less than 60% sequence identity with AacC2c1. The skilled person will understand that this includes truncated forms of the C2c1 protein whereby the sequence identity is determined over the length of the truncated form.

The programmability, specificity, and collateral activity of the RNA-guided C2c1 also make it an ideal switchable nuclease for non-specific cleavage of nucleic acids. In one embodiment, a C2c1 system is engineered to provide and take advantage of collateral non-specific cleavage of RNA. In another embodiment, a C2c1 system is engineered to provide and take advantage of collateral non-specific cleavage of ssDNA. Accordingly, engineered C2c1 systems provide platforms for nucleic acid detection and transcriptome manipulation, and inducing cell death. C2c1 is developed for use as a mammalian transcript knockdown and binding tool. C2c1 is capable of robust collateral cleavage of RNA and ssDNA when activated by sequence-specific targeted DNA binding.

In an embodiment, the C2c1 system is engineered to non-specifically cleave RNA in a subset of cells distinguishable by the presence of an aberrant DNA sequence, for instance where cleavage of the aberrant DNA might be incomplete or ineffectual. In one non-limiting example, a DNA translocation that is present in a cancer cell and drives cell transformation is targeted. Whereas a subpopulation of cells that undergoes chromosomal DNA and repair may survive, non-specific collateral ribonuclease activity advantageously leads to cell death of potential survivors.

Collateral activity was recently leveraged for a highly sensitive and specific nucleic acid detection platform termed SHERLOCK that is useful for many clinical diagnoses (Gootenberg, J. S. et al. Nucleic acid detection with CRISPR-Cas13a/C2c2. Science 356, 438-442 (2017)).

According to the invention, engineered C2c1 systems are optimized for DNA or RNA endonuclease activity and can be expressed in mammalian cells and targeted to effectively knock down reporter molecules or transcripts in cells.

Guide Sequences

As used herein, the term "guide sequence," "crRNA," "guide RNA," or "single guide RNA," or "gRNA" refers to a polynucleotide comprising any polynucleotide sequence having sufficient complementarity with a target nucleic acid sequence to hybridize with the target nucleic acid sequence and to direct sequence-specific binding of an RNA-targeting complex comprising the guide sequence and a CRISPR effector protein to the target nucleic acid sequence. In some example embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq. sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide may be selected to target any target nucleic acid sequence. The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmatic RNA (scRNA). In some preferred embodiments, the target sequence may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide is selected to reduce the degree secondary structure within the nucleic acid-targeting guide. In some embodiments, about or less than about 75%, 50%, 40%, 30%, 25%, 20%, 15%, 10%, 5%, 1%, or fewer of the nucleotides of the nucleic acid-targeting guide participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

In general, the CRISPR-Cas, CRISPR-Cas9 or CRISPR system may be as used in the foregoing documents, such as WO 2014/093622 (PCT/US2013/074667) and refers collectively to transcripts and other elements involved in the expression of or directing the activity of CRISPR-associated ("Cas") genes, including sequences encoding a Cas gene, in particular a Cas9 gene in the case of CRISPR-Cas9, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. The section of the guide sequence through which complementarity to the target sequence is important for cleavage activity is referred to herein as the seed sequence. A target sequence may comprise any polynucleotide, such as DNA or RNA polynucleotides. In some embodiments, a target sequence is located in the nucleus or cytoplasm of a cell, and may include nucleic acids in or from mitochondrial, organelles, vesicles, liposomes or particles present within the cell. In some embodiments, especially for non-nuclear uses, NLSs are not preferred. In some embodiments, a CRISPR system comprises one or more nuclear exports signals (NESs). In some embodiments, a CRISPR system comprises one or more NLSs and one or more NESs. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, i.e. RNA capable of guiding Cas to a target genomic locus, are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting examples of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In some embodiments of CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length; and advantageously tracr RNA is 30 or 50 nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

Guide Modifications

In certain embodiments, guides of the invention comprise non-naturally occurring nucleic acids and/or non-naturally occurring nucleotides and/or nucleotide analogs, and/or chemical modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analogs such as a nucleotide with phosphorothioate linkage, boranophosphate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified bases include, but are not limited to, 2-aminopurine, 5-bromo-uridine, pseudouridine (Ψ), $N^1$-methylpseudouridine ($me^1Ψ$), 5-methoxyuridine (5moU), inosine, 7-methylguanosine. Examples of guide RNA chemical modifications include, without limitation, incorporation of 2'-O-methyl (M), 2'-O-methyl-3'-phosphorothioate (MS), phosphorothioate (PS), S-constrained ethyl(cEt), or 2'-O-methyl-3'-thioPACE (MSP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33(9):985-9, doi: 10.1038/nbt.3290, published online 29 Jun. 2015; Ragdarm et al., 0215, *PNAS*, E7110-E7111; Allerson et al., *J. Med. Chem.* 2005, 48:901-904; Bramsen et al., *Front. Genet.*, 2012, 3:154; Deng et al., *PNAS*, 2015, 112:11870-11875; Sharma et al., *MedChemComm.*, 2014, 5:1454-1471; Hendel et al., *Nat. Biotechnol.* (2015) 33(9): 985-989; Li et al., *Nature Biomedical Engineering*, 2017, 1, 0066 DOI: 10.1038/s41551-017-0066). In some embodiments, the 5' and/or 3' end of a guide RNA is modified by a variety of functional moieties including fluorescent dyes, polyethylene glycol, cholesterol, proteins, or detection tags. (See Kelly et al., 2016, *J. Biotech.* 233:74-83). In certain embodiments, a guide comprises ribonucleotides in a region that binds to a target DNA and one or more deoxyribonucletides and/or nucleotide analogs in a region that binds to Cas9, Cpf1, or C2c1.

In an embodiment of the invention, deoxyribonucleotides and/or nucleotide analogs are incorporated in engineered guide structures, such as, without limitation, 5' and/or 3' end, stem-loop regions, and the seed region. In certain embodiments, the modification is not in the 5'-handle of the stem-loop regions. Chemical modification in the 5'-handle of the stem-loop region of a guide may abolish its function (see Li, et al., *Nature Biomedical Engineering*, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide are chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl-3'-phosphorothioate (MS), S-constrained ethyl(cEt), or 2'-O-methyl-3'-thioPACE (MSP). Such modification can enhance genome editing efficiency (see Hendel et al., *Nat. Biotechnol.* (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guides can mediate enhanced levels of gene disruption (see Ragdarm et al., 0215, *PNAS*, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine. In certain embodiments, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guides can be used to identify or enrich cells generically edited by a CRISPR system (see Lee et al., *eLife*, 2017, 6:e25312, DOI:10.7554)

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, use is made of chemically modified guide RNAs. Examples of guide RNA chemical modifications include, without limitation, incorporation of 2'-O-methyl (M), 2'-O-methyl 3'phosphorothioate (MS), or 2'-O-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 to 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay. Similarly, cleavage of a target RNA may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In some embodiments, the modification to the guide is a chemical modification, an insertion, a deletion or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromo-uridine, pseudouridine ($\Psi$), $N^1$-methylpseudouridine (me$^1\Psi$), 5-methoxyuridine (5moU), inosine, 7-methyl-guanosine, 2'-O-methyl-3'-phosphorothioate (MS), S-constrained ethyl(cEt), phosphorothioate (PS), or 2'-O-methyl-3'-thioPACE (MSP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In certain embodiments, one or more nucleotides in the seed region are chemically modified. In certain embodiments, one or more nucleotides in the 3'-terminus are chemically modified. In certain embodiments, none of the nucleotides in the 5'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 or 10 nucleotides in the 3'-terminus are chemically modified. Such chemical modifications at the 3'-terminus of the Cpf1 CrRNA improve gene cutting efficiency (see Li, et al., *Nature Biomedical Engineering*, 2017, 1:0066). In a specific embodiment, 5 nucleotides in the 3'-terminus are replaced with 2'-fluoro analogues. In a specific embodiment, 10 nucleotides in the 3'-terminus are replaced with 2'-fluoro analogues. In a specific embodiment, 5 nucleotides in the 3'-terminus are replaced with 2'-O-methyl (M) analogs.

In some embodiments, the loop of the 5'-handle of the guide is modified. In some embodiments, the loop of the 5'-handle of the guide is modified to have a deletion, an insertion, a split, or chemical modifications. In certain embodiments, the loop comprises 3, 4, or 5 nucleotides. In certain embodiments, the loop comprises the sequence of UCUU, UUUU, UAUU, or UGUU.

A guide sequence, and hence a nucleic acid-targeting guide RNA may be selected to target any target nucleic acid sequence. In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to an RNA polynucleotide being or comprising the target sequence. In other words, the target RNA may be an RNA polynucleotide or a part of an RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell. The target sequence may be DNA. The target sequence may be any RNA sequence. In some embodiments, the target sequence may be a sequence within an RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nuclear RNA (snoRNA), double stranded RNA (dsRNA), non coding RNA (ncRNA), long non-coding RNA (lncRNA), and small cytoplasmic RNA (scRNA). In some preferred embodiments, the target sequence may be a sequence within an RNA molecule selected from the group consisting of mRNA, pre-mRNA, and rRNA. In some preferred embodiments, the target sequence may be a sequence within an RNA molecule selected from the group consisting of ncRNA, and lncRNA. In some more preferred embodiments, the target sequence may be a sequence within an mRNA molecule or a pre-mRNA molecule.

In certain embodiments, the spacer length of the guide RNA is less than 28 nucleotides. In certain embodiments, the spacer length of the guide RNA is at least 18 nucleotides and less than 28 nucleotides. In certain embodiments, the spacer length of the guide RNA is between 19 and 28 nucleotides. In certain embodiments, the spacer length of the guide RNA is between 19 and 25 nucleotides. In certain embodiments, the spacer length of the guide RNA is 20 nucleotides. In certain embodiments, the spacer length of the guide RNA is 23 nucleotides. In certain embodiments, the spacer length of the guide RNA is 25 nucleotides.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

In certain example embodiments, the cleavage efficiency may be exploited to design single guides that can distinguish two or more targets that vary by a single nucleotide, such as a single nucleotide polymorphism (SNP), variation, or (point) mutation. The CRISPR effector may have reduced sensitivity to SNPs (or other single nucleotide variations) and continue to cleave SNP targets with a certain level of efficiency. Thus, for two targets, or a set of targets, a guide RNA may be designed with a nucleotide sequence that is complementary to one of the targets i.e. the on-target SNP. The guide RNA is further designed to have a synthetic mismatch. As used herein a "synthetic mismatch" refers to a non-naturally occurring mismatch that is introduced upstream or downstream of the naturally occurring SNP, such as at most 5 nucleotides upstream or downstream, for instance 4, 3, 2, or 1 nucleotide upstream or downstream, preferably at most 3 nucleotides upstream or downstream, more preferably at most 2 nucleotides upstream or downstream, most preferably 1 nucleotide upstream or downstream (i.e. adjacent the SNP). When the CRISPR effector binds to the on-target SNP, only a single mismatch will be formed with the synthetic mismatch and the CRISPR effector will continue to be activated and a detectable signal produced. When the guide RNA hybridizes to an off-target SNP, two mismatches will be formed, the mismatch from the SNP and the synthetic mismatch, and no detectable signal generated. Thus, the systems disclosed herein may be designed to distinguish SNPs within a population. For example, the systems may be used to distinguish pathogenic strains that differ by a single SNP or detect certain disease specific SNPs, such as but not limited to, disease associated SNPs, such as without limitation cancer associated SNPs.

In certain embodiments, the guide RNA is designed such that the SNP is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the SNP is located on position 1, 2, 3, 4, 5, 6, 7, 8, or 9 of the spacer sequence (starting at the 5' end). In certain embodiments, the guide RNA is designed such that the SNP is located on position 2, 3, 4, 5, 6, or 7 of the spacer sequence (starting at the 5' end). In certain embodiments, the guide RNA is designed such that the SNP is located on position 3, 4, 5, or 6 of the spacer sequence (starting at the 5' end). In certain embodiments, the guide RNA is designed such that the SNP is located on position 3 of the spacer sequence (starting at the 5' end).

In certain embodiments, the guide RNA is designed such that the mismatch (e.g. the synthetic mismatch, i.e. an additional mutation besides a SNP) is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the mismatch is located on position 1, 2, 3, 4, 5, 6, 7, 8, or 9 of the spacer sequence (starting at the 5' end). In certain embodiments, the guide RNA is designed such that the mismatch is located on position 4, 5, 6, or 7 of the spacer sequence (starting at the 5' end). In certain embodiments, the guide RNA is designed such that the mismatch is located on position 5 of the spacer sequence (starting at the 5' end).

In certain embodiments, the guide RNA is designed such that the mismatch is located 2 nucleotides upstream of the SNP (i.e. one intervening nucleotide).

In certain embodiments, the guide RNA is designed such that the mismatch is located 2 nucleotides downstream of the SNP (i.e. one intervening nucleotide).

In certain embodiments, the guide RNA is designed such that the mismatch is located on position 5 of the spacer sequence (starting at the 5' end) and the SNP is located on position 3 of the spacer sequence (starting at the 5' end).

The embodiments described herein comprehend inducing one or more nucleotide modifications in a eukaryotic cell (in vitro, i.e. in an isolated eukaryotic cell) as herein discussed comprising delivering to the cell a vector as herein discussed. The mutation(s) can include the introduction, deletion, or substitution of one or more nucleotides at each target sequence of cell(s) via the guide(s) RNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets.

Signal Amplification CRISPR Effector Proteins

In certain example embodiments, the signal amplification CRISPR effector protein is a Type III-A CRISPR-Cas system effector protein. In certain example embodiments, the Type III-A CRISPR-Cas effector protein is Csm6. Csm6 functions with the multiprotein Csm effector complex, but is not part of the complex (see, e.g., US20170198286 A1; WO2016035044A1; M. Kazlauskiene et al., Science 10.1126/science.aao0100 (2017); and Niewoehner et al. 2017, bioRxiv preprint first posted online Jun. 23, 2017; doi: dx.doi.org/10.1101/153262).

In *Staphylococcus epidermidis* the Csm complex (SeCsm) is comprised of Cas10, Csm2, Csm3, Csm4, and Csm5 proteins. The Type III-A CRISPR-Cas system was demonstrated to have RNA cleavage activity both in vitro and in the cell using the Csm complex for *Streptococcus thermophilus* (St) (see, e.g., US20170198286 A1).

Type III-A CRISPR-Cas systems include *Streptococcus thermophilus* (GenBank KM222358), DGCC7710 (GenBank AWVZ01000003), LMD-9 (GenBank NC008532), *Staphylococcus epidermidis* RP62a (GenBank NC002976), *Enterococcus italicus* DSM15952 (GenBank AEPV01000074), *Lactococcus lactis* DGCC7167 (GenBank JX524189) and *Sulfolobus solfataricus* P2 (GenBank AE006641). The Type III-A system of DGCC8004 contains 10 cas genes flanking the CRISPR2 array and includes cas1, cas2, cash, cas10, csm2, csm3, csm4, csm5, csm6 and csm6' genes. The DGCC8004 CRISPR2 locus shares a similar gene arrangement to that of DGCC7710 (GenBank AWVZ00000000, (Horvath and Barrangou, 2010)) and LMD-9 (GenBank NC_008532, (Makarova et al., 2006)). The major difference is an additional csm6' gene in DGCC8004. The Csm6' protein in DGCC8004 is comprised of 386 aa and shows—34% amino acid identity to the 428 aa Csm6 protein, suggesting a possible ancient gene duplication event followed by sequence divergence. In contrast, DGCC7710 contains only a short 117-nt ORF in front of csm6. The Cas/Csm proteins associated to CRISPR2 in DGCC8004 are homologous to the corresponding proteins in DGCC7710 and LMD-9 (more than 90% aa identity, except for the Csm2 protein, which shares ~70% identity). Other experimentally characterized Type III-A systems including *S. epidermidis* RP62a (GenBank NC002976, (Marraffini and Sontheimer, 2008)), *Enterococcus italicus* DSM15952 (GenBank AEPV01000074, (Millen et al., 2012)) and *Lactococcus lactis* DGCC7167 (GenBank JX524189, (Millen et al., 2012)) share with DGCC8004 a conserved arrangement of the cas10-csm2-csm3-csm4-csm5-csm6 gene cluster, while the position of cas6 and cas1/cas2 genes differ in some strains. The Type III-A CRISPR-Cas locus in *S. solfataricus* P2 (GenBank AE006641) has different gene organization and shows low protein sequence similarity to Cas/Csm orthologues in DGCC8004. Noteworthy, the Csm3 protein is most conserved among the Cas/Csm proteins across different strains and 5 copies of the Csm3 paralogues are present in *S. solfataricus*. Repeat sequences in *S. epidermidis, E. italicus* and *L. lactis* are of the same length (36 nt), however the nucleotide conservation is limited to the palindromic parts and 3'-terminal end of the repeats. The 8-nt 3'-terminal sequence of the repeat, which may contribute to the crRNA 5'-handle, shows an ACGRRAAC consensus between *S. thermophilus, S. epidermidis, E. italicus* and *L. lactis* but differs from that of *S. solfataricus* (AUUGAAG (Rouillon et al., 2013)).

Csm6 has been shown to be a ssRNA-specific endoribonuclease and the structural basis for this activity was determined (Niewoehner and Jinek, 2016, Structural basis for the endoribonuclease activity of the type III-A CRISPR-associated protein Csm6. RNA 22:318-329).

In some embodiments, one or more elements of a nucleic acid-targeting system of the present invention is derived from a particular organism comprising an endogenous CRISPR RNA-targeting system. In certain embodiments, the CRISPR RNA-targeting system comprises a Csm6 protein, Csm6 orthologue, or Csm6-like protein. As used herein, discussion of Csm6 also refers to Csm6 proteins, Csm6 orthologues, or Csm6-like proteins. Csm6 orthologues may be found in organisms as described herein and known in the art (see, e.g., WO2016035044A1 and Niewoehner and Jinek, 2016). Exemplary Csm6 orthologues include, but are not limited to *T. thermophilus* (TtCsm6, GI:55978335), *S. epidermidis* (SeCsm6, GI:488416649), *S. mutans* (SmCsm6, GI:24379650), *S. thermophiles* (StCsm6, GI:585230687), and *P. furiosus* Csx1 (PfCsx1, GI:33359545). In certain embodiments, Csm6 proteins useful for the present invention comprise at least one N-terminal CARF (CRISPR-associated Rossman fold) domain and at least one C-terminal HEPN domain (higher eukaryotes and prokaryotes nucleotide-binding domain). In certain embodiments, Csm6 proteins form dimers. In certain embodiments, dimerization of the HEPN domains leads to the formation of a ribonuclease active site. In certain embodiments, the dimer interface of the CARF domains comprise an electropositive pocket. Not being bound by a theory, the pocket may function as a ligand-binding site for allosteric control of ribonuclease activity.

In certain example embodiments, the CRISPR-based detection systems described herein comprise a Csm6 protein comprising at least one HEPN domain, including but not limited to the HEPN domains described herein, HEPN domains known in the art (Niewoehner and Jinek, 2016), and domains recognized to be HEPN domains by comparison to consensus sequence motifs. Several such domains are provided herein. In one non-limiting example, a consensus sequence can be derived from the sequences of C2c2 or Cas13b orthologs provided herein. In certain example embodiments, the Csm6 protein comprises a single HEPN domain. In certain other example embodiments, the Csm6 protein comprises two HEPN domains.

In one example embodiment, the Csm6 protein comprises one or more HEPN domains comprising an RxxxxH motif sequence. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed herein. In certain embodiments, the HEPN domain comprises a conserved R-X4-6-H motif (Anantharaman et al., Biol Direct. 2013 Jun. 15; 8:15; and Kim et al., Proteins. 2013 February; 81(2):261-70).

In an embodiment of the invention, a HEPN domain comprises at least one RxxxxH motif comprising the sequence of R{N/H/K}X1X2X3H. In an embodiment of the invention, a HEPN domain comprises a RxxxxH motif comprising the sequence of R{N/H}X1X2X3H. In an embodiment of the invention, a HEPN domain comprises the sequence of R{N/K}X1X2X3H. In certain embodiments, X1 is R, S, D, E, Q, N, G, Y, or H. In certain embodiments, X2 is I, S, T, V, or L. In certain embodiments, X3 is L, F, N, Y, V, I, S, D, E, or A.

CARF domains and consensus sequences for CARF domains have been described (see, e.g., Makarova et al., Front Genet. 2014; 5: 102). In certain embodiments, Csm6 comprises at least one CARF domain comprising a core domain comprising a six-stranded Rossmann-like fold with the core strand-5 and strand-6 forming a β-hairpin. The main regions of sequence conservation are associated with strand-1 and strand-4 of the core domain. In certain embodiments, the end of strand-1 is characterized by a polar residue, typically with an alcoholic side chain (S/T). In certain embodiments, immediately downstream of strand-4 is a highly conserved basic residue (K/R), preferably associated with a [DN]X[ST]XXX[RK] signature (SEQ ID NO:430). In certain embodiments, Csm6 is truncated to remove the N-terminal CARF domain (e.g., amino acids 1-190 of TtCsm6 or the equivalent residues in orthologous Csm6 proteins).

In certain embodiments, Csm6 comprises at least one 6H domain (Niewoehner and Jinek, 2016). The 6H domain of TtCsm6 polypeptide chain (residues 191-292) consists of five α-helices and forms a right-handed solenoid domain. Not being bound by a theory, since some orthologues may not have a 6H domain, this domain is not required for activity of the Csm6 protein of the present invention.

Csm6 has been shown to contribute to interference by functioning as a standalone ribonuclease that degrades invader RNA transcripts. Csm6 proteins are activated through a second messenger generated by the type III interference complex. Upon target RNA binding by the type III interference complex, the Cas10 subunit converts ATP into a cyclic oligoadenylate product, which allosterically activates Csm6 by binding to its CARF domain. CARF domain mutations that abolish allosteric activation inhibit Csm6 activity in vivo, and mutations in the Cas10 Palm domain phenocopy loss of Csm6 (M. Kazlauskiene et al., 2017; and Niewoehner et al. 2017).

In certain example embodiments, the signal amplification CRISPR effector protein is activated when the activated CRISPR detection protein cleaves an activation sequence. The activation sequences are described in further detail below. The cleavage product of the activation sequence activates a separate activity of the signal amplification CRISPR effector protein, such as an RNA nuclease activity. For example, Csm6, once activated, cleaves RNA indiscriminately similar to the collateral effect of Cas13 enzymes. Thus, in addition to detection effector modification of reporter constructs, the activated signal amplification CRISPR effector protein also modifies reporter constructs to further enhance signal generation. In certain embodiments, Csm6 is activated when provided in conjunction with another CRISPR enzyme (e.g., Cas13). In certain embodiments, Csm6 can generate a synergistic effect when used in conjunction with Cas13, such that Cas13 collateral activity is greatly increased. Not being bound by a theory, the concentration of Cas13 can be greatly decreased in an assay when Csm6 is also included in the assay (e.g., point of care assay). Thus, Csm6 addition to a Cas13 diagnostic assay can be used to increase sensitivity of the assay and decrease cost.

In certain example embodiments, the one or more signal amplification effector proteins are selected from Table 6.

TABLE 6

| EiCsm6 | WP_007208953.1 | Enterococcus italicus | MKILFSPIGNTDPWRNDRDGAMLHIVRHYQPDRVLFFTESIWQGNQHFSGQQAFDMVKIIQSINENCQIEIKCDT IEVENDFDAYKDLFHQYLVEEKRKYPNAEIFLNVTSGTPQMETTLCLEYVTYPDKMRCIQVSTPLKTSNAKTKYA QADCQEVDLEIVNEBESQQPSRCHKIAILSFREAIVRNQIKSLLDNYDYEAALQLVASQKSFRNGKEIRKLKELID DIKMHRVFSYLIKQYPRNEKLQKALLHTILLEMRHQRGDIAETLIRVKSIAEYIVEQVIQKNYPYLIIYKEDKPYFN VSYSQELTESYIALMDSRNKKTNKKMTVDSLDRILGFPAYRDFLQLLEASNEMTNEMNKVNEINNLANKVAHN LDSLNLDRDKNGRKITNAVTAVRTMLLAVFPEVQENDFHYLKQFNQSIKELL |
| TtCsm6 | WP_11229148.1 | Thermus thermophilus | MEDLDALWERYREAVRAGGNPQALYQEMVWPALLALWREKPRVYPPQAFAVSVHTLGTSPEATALAILGAG AERVVLHTPESARFLPRLRQDTGKDLYPVEIGKSDVEAIYREVKRLLEKHPEVPVALDLTSGTKAMSAGLAAA GFFPQRFPYPKVRVVVDNEDYDPELRRPRAGTEKLRILPNPHEALAEVDALFAKELYGKGFGQAAAYFRGMVG RTGNQAYALYALLAEMYRAWRALDFGEALKAGRKLLGQLSQNVWLNHPLNARREALEAQVALLEAVDRFLKA RDFALKEGVYGLARTLLHLLAQEAKEERAAVLAALYAYRALELLQERLALLGRRAAFAPGLSPEEAEARALRKALAEL LGVLPEVRLPAKLGLLDLLAPLIRLKGDEALGRLSLAELRGLAGALKGRNSALLVHGFDVPSPKAVEGIARLAQG LLQDLEARTALGPLSPEPVPLGF |
| StCsm6 | WP_000865879.1 | Staphylococcus | MKVLFSPIGNSDPWSNDRDGAMLHIVRHYKPDWVLFFTESIWNGNRNIPGRKNFDWENIVSKVSSRTKVDIKVD SIKYENDFDSYKDIFHFYINEIRTKYSDAEILLNVTSGTPQMESTLCLEYISNPHNMKCIQVSTPAPIEGPKRSFAKL ETVTEDLNKVNANEKMASNRSKSINIISFREVMVRSQIKSLVNNDYEGALNLVSDQKSFRNGKLLRKRLLELTN QIKTHEVFPEINDKYRSVALKKSLFHYLLLNMRYNRLDVAETLIRVKSIAEFILKTYIVGHWPTLIIEKDDKPYLNA EDNLSFIYKYKLLLEKRQNLDVSRILGLPAFIDILTVLEPNSKLLKEVNAVNDINGLRNSIAHNLETLDLDKNKNY KKIMLSVEAIKNMLHISFPEIEEKDYNYFERKNKEFRELL |
| ShCsm6 | WP_085050120.1 | Staphylococcus haemolyticus | MKVLFSPIGNSDPWSNDRDGAMLHIVRHYKPDVVVLFFTESIWNGNRNIPGRKNFDWENIVSKVSSRTKVDIKVD SIKYENDFDSYKDIFHFYINEIRTKYSDAEILLNVTSGTPQMESTLCLEYISNPHNMKCIQVSTPAPIEGPKRSFAKL ETVTEDLNKVNANEKMASNRSKSINIISFREVMVRSQIKSLVNNDYEGALNLVSDQKSFRNGKLLRKRLLELTN QIKTHEVFPEINDKYRSVALKKSLFHYLLLNMRYNRLDVAETLIRVKSIAEFILKTYIVGHWPTLIIEKDDKPYLNA EDNLSFIYKYKLLLEKRQNLDVSRILGLPAF |
| PtCsm6 | WP_078807318.1 | Pilibacter termitis | MRCLITCVGDTDPIRNLHDGGILHIARVYRPEKIILIFISERSLAKHENVVKALNGIAHYOPEILQEEHVLKNSEVFLF DKMFEQISSIVTKYRQTFSEDVEILLNLSSATPQVISAMPAINRIBEMNTQAIQVATPVKNSNEGVGHDNKEDIQDL IETNLDNQGDFENRCVEDEGVNFSQALLKRKLRQFIEEYDYCAAYQLIHKEKGIPARKILLKELECLKNDIQTQSIP EKIKKMKFPEEIKKSLNAYLILDLKHKRGEVAEVLIRVKSPAEFVLECFFNEEQSNLIIVKEDKPYLNVQDFPKIKE NLDRMSREKGYEEFRESTILSLPIYMNILKFLYPEDSNRKKLNKIQQINGLANNVAHRLDGFDKKNLKNVNGAVK ACRELLLVFKIDEKYLNYYDDQNKLLLERLEDNH |
| SaCsm6 | EHO90787.1 | Staphylococcus aureus subsp. aureus 21252 | MESTLCLEYISNPNNMQCIQVSTPAPTEGPRRSFAKPETLIEDLNKVNDNEKVATNRSKSIDIISFREVMVRSQIKG LVDNDYEGALNLVSNQKSFRNGKLLRKKLLALTNQIKTHEVFPEINVKYNNAALKKSLFHYLLVNMRYNRLD VAETLIRVKSTAEFIIKTYLENHWTHLMIEIDGKPYLNAEDNLSFIYKYKLLLEKRKQNLDTSRIILGLPAFIDMLSIL EPKSKLLKEVKAVNDINGLRNSIAHNLEALNLDKNKNYKKIMLSVEAIKNMLNISFPEIDEQDYNYFEEKNKEFK KLL |
| ThCsm6 | WP_094243908.1 | Tetragenococcus halophilus | MQTLISCVGDTDPIRNVHDGPLLHIARGIRPEKIVIVHSERSQEKHDNIVKALHSIPDYHPEIVVDERIIKNDDIFLFD KMFEVLSKIIQEYARSEEEIILNLTSATPQIISAMPSINRISGLNVRAYQVATPSNTSNEGIKHNNQQDIQQLIESNKD NRKDYNNRLIEDKAEKFQQLLVRKTFIDLIREYDYEGAVQVISGNDLMLSKKKKGKLHHELDNLIKSIKTQNLLP EVENSEPDVSQKTILNAYLLISLQAKRELNTEVLIRVKNPAEFIVEMYLDKNYNGLIVRDGKPYLNIEGFEDVVL KLRYSLKKAGNELNTDRYLSLPLYAELIRIIQPDSSLLKLIDKVNGVNTFRNQVAHGFKSINMKNSRVKDLAETCW MLLIVNDVDEKWRSYFEDKNKVFKEMVGY |

TABLE 6-continued

| FsCsm6 | WP_069876671.1 Fusibacter sp. 3D3 | MERILFSFVGMTDPIKGYHDGPLIHIVRHYRPQKVYAYFSKETGDIEREFGIVSKAVHLVDPDCIVESLFYDVDV<br>SDFDIFSKHIVDIFRLIEKENPLSEILVNMTSGTLQMISSTCLLVSHLNMKPRLIQVKTPEKSANRDKHLHFDPKVDP<br>IEDYYEGENLDVLEGSPSRCHELQILSYKKTVIKSQIESLIKGYDYDAAEKYLIKNSNLFEAENYEKAISLLKHARL<br>RINFECKEAEKIAQKLNLKALYPIDDIKVKMIVEYYLIMNLQRQKKDMSSFVLKLSPLSDEIARYILIEKFGINISQI<br>AIKKKDIYKFDQQRSENELPGISAYLDEKFKEMNLGVFLWDRPLNFASMISFVEYLQTYKKPLNHPEVFPELKKW<br>QNISKIRNMTAHTLTETSEHSIATVYGDNSKKLCSRIEFVLKDIFKGKLKEEIFAIYDKINEMILEAL |
| --- | --- | --- |
| LaCsm6 | WP_056988115.1 Lactobacillus acidipiscis | MTTLFSCVGFSDPFRNGYDGPLLNIVRSKKPDKIILVFSEGTIGNQEKISAAINGIEDSYKPSIIVDPEETPDKDTPYF<br>DKMFKILYDKIMKYFLEEENITLNLSSGTPAMESALFSINRILGLNVSAYQVKTPVNDSNENIEFNLSDGNDGESPE<br>STVQNTSDRILSDKGEKFEQTLIKENVKQFIQEYDYLSAYELIKNDPVLSTKEELSNKLEQFVVALKYQRVFPAVK<br>VKKYDKEKTILLNSFLIFLLQVKRGMTSEVVIRGRNLTEFICEMYLNKNYQGLIKYDEHQLPLNESEFTEIREQLY<br>NNRLSTFSFLSFPVYQGIFKALGESEIGKALDQLSIFNIRNQIAHNFNELSEKKVNLLLKYYSTDNSYEIVNALLSLI<br>KFVFNLSKEWLIFFETENKNIISLLEK |
| LsCsm6 | WP_081509150.1 Lactobacillus salivarius | MTTLISCIGDTDPIRNRHDGALLHLARVFRPKKILLIYSERALLKENNILLALNSIEGYSPVIKDERLISNSEVFIFD<br>KMYEILNNVVLKYSRDDEDLILNLSSGTPQMKSALFTINALNDINVRAYQVITPSHSSNEGIRHDNNLDINYLISTN<br>LDNRKDFEKRILEDKAEKFQKTLIKRTMKDLLNNFDYESLYDLSMRHRVLSKSKMKKIISLLQDLTEAVKYQKLL<br>KVVNQTNYCEKEKKLINSYLIILLQVNRELVSEVLIRSKNIGEYACELYLEKNYPDLIFWKENRPYLNSENYPNIED<br>KILNNEDIHYRKEQYLNIHLYIKILEELNGNEELIESLNKLSGYNQQRNKVAHGLSEISASQVNVRKIVNLCYQIVS<br>ECVDLTEDWSKFYDQFNNKISIMLDE |

CRISPR effectors often interact with additional components to modulate activity, and Type VI-B CRISPR systems often harbor the interference-modulating proteins Csx27 and Csx28, and Csx28 co-expression has been demonstrated to increase the interference activity of Cas13b proteins in vivo. In certain embodiments, the one or more signal amplification CRISPR effector proteins comprise Csx28 or Csx27.

Amplification of Target

In certain example embodiments, target RNAs and/or DNAs may be amplified prior to activating the CRISPR effector protein. Any suitable RNA or DNA amplification technique may be used. In certain example embodiments, the RNA or DNA amplification is an isothermal amplification. In certain example embodiments, the isothermal amplification may be nucleic-acid sequenced-based amplification (NASBA), recombinase polymerase amplification (RPA), loop-mediated isothermal amplification (LAMP), strand displacement amplification (SDA), helicase-dependent amplification (HDA), or nicking enzyme amplification reaction (NEAR). In certain example embodiments, non-isothermal amplification methods may be used which include, but are not limited to, PCR, multiple displacement amplification (MDA), rolling circle amplification (RCA), ligase chain reaction (LCR), or ramification amplification method (RAM).

In certain example embodiments, the RNA or DNA amplification is nucleic acid sequence-based amplification NASBA, which is initiated with reverse transcription of target RNA by a sequence-specific reverse primer to create an RNA/DNA duplex. RNase H is then used to degrade the RNA template, allowing a forward primer containing a promoter, such as the T7 promoter, to bind and initiate elongation of the complementary strand, generating a double-stranded DNA product. The RNA polymerase promoter-mediated transcription of the DNA template then creates copies of the target RNA sequence. Importantly, each of the new target RNAs can be detected by the guide RNAs thus further enhancing the sensitivity of the assay. Binding of the target RNAs by the guide RNAs then leads to activation of the CRISPR effector protein and the methods proceed as outlined above. The NASBA reaction has the additional advantage of being able to proceed under moderate isothermal conditions, for example at approximately 41° C., making it suitable for systems and devices deployed for early and direct detection in the field and far from clinical laboratories.

In certain other example embodiments, a recombinase polymerase amplification (RPA) reaction may be used to amplify the target nucleic acids. RPA reactions employ recombinases which are capable of pairing sequence-specific primers with homologous sequence in duplex DNA. If target DNA is present, DNA amplification is initiated and no other sample manipulation such as thermal cycling or chemical melting is required. The entire RPA amplification system is stable as a dried formulation and can be transported safely without refrigeration. RPA reactions may also be carried out at isothermal temperatures with an optimum reaction temperature of 37-42° C. The sequence specific primers are designed to amplify a sequence comprising the target nucleic acid sequence to be detected. In certain example embodiments, an RNA polymerase promoter, such as a T7 promoter, is added to one of the primers. This results in an amplified double-stranded DNA product comprising the target sequence and a RNA polymerase promoter. After, or during, the RPA reaction, a RNA polymerase is added that will produce RNA from the double-stranded DNA templates. The amplified target RNA can then in turn be detected by the CRISPR effector system. In this way target DNA can be detected using the embodiments disclosed herein. RPA reactions can also be used to amplify target RNA. The target RNA is first converted to cDNA using a reverse transcriptase, followed by second strand DNA synthesis, at which point the RPA reaction proceeds as outlined above.

Accordingly, in certain example embodiments the systems disclosed herein may include amplification reagents. Different components or reagents useful for amplification of nucleic acids are described herein. For example, an amplification reagent as described herein may include a buffer, such as a Tris buffer. A Tris buffer may be used at any concentration appropriate for the desired application or use, for example including, but not limited to, a concentration of 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 25 mM, 50 mM, 75 mM, 1 M, or the like. One of skill in the art will be able to determine an appropriate concentration of a buffer such as Tris for use with the present invention.

A salt, such as magnesium chloride ($MgCl_2$), potassium chloride (KCl), or sodium chloride (NaCl), may be included in an amplification reaction, such as PCR, in order to improve the amplification of nucleic acid fragments. Although the salt concentration will depend on the particular reaction and application, in some embodiments, nucleic acid fragments of a particular size may produce optimum results at particular salt concentrations. Larger products may require altered salt concentrations, typically lower salt, in order to produce desired results, while amplification of smaller products may produce better results at higher salt concentrations. One of skill in the art will understand that the presence and/or concentration of a salt, along with alteration of salt concentrations, may alter the stringency of a biological or chemical reaction, and therefore any salt may be used that provides the appropriate conditions for a reaction of the present invention and as described herein.

Other components of a biological or chemical reaction may include a cell lysis component in order to break open or lyse a cell for analysis of the materials therein. A cell lysis component may include, but is not limited to, a detergent, a salt as described above, such as NaCl, KCl, ammonium sulfate [$(NH_4)_2SO_4$], or others. Detergents that may be appropriate for the invention may include Triton X-100, sodium dodecyl sulfate (SDS), CHAPS (3-[(3-cholamidopropyl)dimethylammonio]-1-propanesulfonate), ethyl trimethyl ammonium bromide, nonyl phenoxypolyethoxylethanol (NP-40). Concentrations of detergents may depend on the particular application, and may be specific to the reaction in some cases. Amplification reactions may include dNTPs and nucleic acid primers used at any concentration appropriate for the invention, such as including, but not limited to, a concentration of 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, 950 nM, 1 mM, 2 mM, 3 mM, 4 mM, 5 mM, 6 mM, 7 mM, 8 mM, 9 mM, 10 mM, 20 mM, 30 mM, 40 mM, 50 mM, 60 mM, 70 mM, 80 mM, 90 mM, 100 mM, 150 mM, 200 mM, 250 mM, 300 mM, 350 mM, 400 mM, 450 mM, 500 mM, or the like. Likewise, a polymerase useful in accordance with the invention may be any specific or general polymerase known in the art and useful for the invention, including Taq polymerase, Q5 polymerase, or the like.

In some embodiments, amplification reagents as described herein may be appropriate for use in hot-start amplification. Hot start amplification may be beneficial in some embodiments to reduce or eliminate dimerization of adaptor molecules or oligos, or to otherwise prevent unwanted amplification products or artifacts and obtain optimum amplification of the desired product. Many components described herein for use in amplification may also be used in hot-start amplification. In some embodiments, reagents or components appropriate for use with hot-start amplification may be used in place of one or more of the composition components as appropriate. For example, a polymerase or other reagent may be used that exhibits a desired activity at a particular temperature or other reaction condition. In some embodiments, reagents may be used that are designed or optimized for use in hot-start amplification, for example, a polymerase may be activated after transposition or after reaching a particular temperature. Such polymerases may be antibody-based or apatamer-based. Polymerases as described herein are known in the art. Examples of such reagents may include, but are not limited to, hot-start polymerases, hot-start dNTPs, and photo-caged dNTPs. Such reagents are known and available in the art. One of skill in the art will be able to determine the optimum temperatures as appropriate for individual reagents.

Amplification of nucleic acids may be performed using specific thermal cycle machinery or equipment, and may be performed in single reactions or in bulk, such that any desired number of reactions may be performed simultaneously. In some embodiments, amplification may be performed using microfluidic or robotic devices, or may be performed using manual alteration in temperatures to achieve the desired amplification. In some embodiments, optimization may be performed to obtain the optimum reaction conditions for the particular application or materials. One of skill in the art will understand and be able to optimize reaction conditions to obtain sufficient amplification.

In certain embodiments, detection of DNA with the methods or systems of the invention requires transcription of the (amplified) DNA into RNA prior to detection.

Enhancement of Detectable Positive Signal

In certain example embodiments, further modifications may be introduced that further amplify the detectable positive signal. For example, activated CRISPR effector protein collateral activation may be used to generate a secondary target or additional guide sequence, or both. In one example embodiment, the reaction solution would contain a secondary target that is spiked in at high concentration. The secondary target may be distinct from the primary target (i.e. the target for which the assay is designed to detect) and in certain instances may be common across all reaction volumes. A secondary guide sequence for the secondary target may be protected, e.g. by a secondary structural feature such as a hairpin with an RNA loop, and unable to bind the second target or the CRISPR effector protein. Cleavage of the protecting group by an activated CRISPR effector protein (i.e. after activation by formation of complex with the primary target(s) in solution) and formation of a complex with free CRISPR effector protein in solution and activation from the spiked in secondary target. In certain other example embodiments, a similar concept is used with free guide sequence to a secondary target and protected secondary target. Cleavage of a protecting group off the secondary target would allow additional CRISPR effector protein, guide sequence, secondary target sequence to form. In yet another example embodiment, activation of CRISPR effector protein by the primary target(s) may be used to cleave a protected or circularized primer, which would then be released to perform an isothermal amplification reaction, such as those disclosed herein, on a template for either secondary guide sequence, secondary target, or both. Subsequent transcription of this amplified template would produce more secondary guide sequence and/or secondary target sequence, followed by additional CRISPR effector protein collateral activation.

Example Methods and Assays

The low cost and adaptability of the assay platform lends itself to a number of applications including (i) general RNA/DNA quantitation, (ii) rapid, multiplexed RNA/DNA expression detection, and (iii) sensitive detection of target nucleic acids, peptides in both clinical and environmental samples. Additionally, the systems disclosed herein may be adapted for detection of transcripts within biological settings, such as cells. Given the highly specific nature of the CRISPR effectors described herein, it may be possible to track allelic specific expression of transcripts or disease-associated mutations in live cells.

In certain example embodiments, a single guide sequence specific to a single target is placed in separate volumes. Each volume may then receive a different sample or aliquot of the same sample. In certain example embodiments, multiple guide sequences each to a separate target may be placed in a single well such that multiple targets may be screened in a different well. In order to detect multiple guide RNAs in a single volume, in certain example embodiments, multiple effector proteins with different specificities may be used. For example, different orthologs with different sequence specificities may be used. For example, one orthologue may preferentially cut A, while others preferentially cut C, G, U/T. Accordingly, masking constructs that are all, or comprise a substantial portion, of a single nucleotide may be generated, each with a different fluorophore which can be detected at differing wavelengths. In this way, up to four different targets may be screened in a single individual discrete volume. In certain example embodiments, different orthologues from a same class of CRISPR effector protein may be used, such as two Cas13a orthologues, two Cas13b orthologues, or two Cas13 orthologues. The nucleotide preferences of various Cas13 proteins are shown in FIG. 67. In certain other example embodiments, different orthologues with different nucleotide editing preferences may be used, such as a Cas13a and a Cas13b ortholog, or a Cas13a and a Cas13c ortholog, or a Cas13b ortholog and a Cas13c ortholog etc. In certain example embodiments, a Cas13 protein with a polyU preference and a Cas13b protein with a polyA preference are used. In certain example embodiments, the Cas13b protein with a polyU preference is a *Prevotella intermedia* Cas13b and the Cas13b protein with a polyA preference is a *Prevotella* sp. MA2106 Cas13b protein. In certain example embodiments, the Cas13 protein with a polyU preference is a *Leptotrichia wadei* Cas13a protein and the Cas13 protein with a poly A preference is a *Prevotella* sp. MA2106 Cas13b protein.

As demonstrated herein, the CRISPR effector systems are capable of detecting down to attomolar concentrations of target molecules. See e.g. FIGS. 13, 14, 19, 22 and Examples described below. Due to the sensitivity of said systems, a number of applications that require rapid and sensitive detection may benefit from the embodiments disclosed herein, and are contemplated to be within the scope of the invention. Example assays and applications are described in further detail below.

Microbial Applications

In certain example embodiments, the systems, devices, and methods, disclosed herein are directed to detecting the presence of one or more microbial agents in a sample, such as a biological sample obtained from a subject. In certain example embodiments, the microbe may be a bacterium, a fungus, a yeast, a protozoan, a parasite, or a virus. Accordingly, the methods disclosed herein can be adapted for use in other methods (or in combination) with other methods that require quick identification of microbe species, monitoring the presence of microbial proteins (antigens), antibodies, antibody genes, detection of certain phenotypes (e.g. bacterial resistance), monitoring of disease progression and/or outbreak, and antibiotic screening. Because of the rapid and sensitive diagnostic capabilities of the embodiments disclosed here, detection of microbe species type, down to a single nucleotide difference, and the ability to be deployed as a POC device, the embodiments disclosed herein may be used as guide therapeutic regimens, such as a selection of the appropriate antibiotic or antiviral. The embodiments disclosed herein may also be used to screen environmental samples (air, water, surfaces, food etc.) for the presence of microbial contamination.

Disclosed is a method to identify microbial species, such as bacterial, viral, fungal, yeast, or parasitic species, or the like. Particular embodiments disclosed herein describe methods and systems that will identify and distinguish microbial species within a single sample, or across multiple samples, allowing for recognition of many different microbes. The present methods allow the detection of pathogens and distinguishing between two or more species of one or more organisms, e.g., bacteria, viruses, yeast, protozoa, and fungi or a combination thereof, in a biological or environmental sample, by detecting the presence of a target nucleic acid sequence in the sample. A positive signal obtained from the sample indicates the presence of the microbe. Multiple microbes can be identified simultaneously using the methods and systems of the invention, by employing the use of more than one effector protein, wherein each effector protein targets a specific microbial target sequence. In this way, a multi-level analysis can be performed for a particular subject in which any number of microbes can be detected at once. In some embodiments, simultaneous detection of multiple microbes may be performed using a set of probes that can identify one or more microbial species.

Multiplex analysis of samples enables large-scale detection of samples, reducing the time and cost of analyses. However, multiplex analyses are often limited by the availability of a biological sample. In accordance with the invention, however, alternatives to multiplex analysis may be performed such that multiple effector proteins can be added to a single sample and each masking construct may be combined with a separate quencher dye. In this case, positive signals may be obtained from each quencher dye separately for multiple detection in a single sample.

Disclosed herein are methods for distinguishing between two or more species of one or more organisms in a sample. The methods are also amenable to detecting one or more species of one or more organisms in a sample.

Microbe Detection

In some embodiments, a method for detecting microbes in samples is provided comprising distributing a sample or set of samples into one or more individual discrete volumes, the individual discrete volumes comprising a CRISPR system as described herein; incubating the sample or set of samples under conditions sufficient to allow binding of the one or more guide RNAs to one or more microbe-specific targets; activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample. The one or more target molecules may be mRNA, gDNA (coding or non-coding), trRNA, or RNA comprising a target nucleotide tide sequence that may be used to distinguish two or more microbial species/strains from one another. The guide RNAs may be designed to detect target sequences. The embodiments disclosed herein may also utilize certain steps to improve hybridization between guide RNA and target RNA sequences. Methods for enhancing ribonucleic acid hybridization are disclosed in WO 2015/085194, entitled "Enhanced Methods of Ribonucleic Acid Hybridization" which is incorporated herein by reference. The microbe-specific target may be RNA or DNA or a protein. A DNA method may further comprise the use of DNA primers that introduce an RNA polymerase promoter as described herein. If the target is a protein then the method will utilize aptamers and steps specific to protein detection described herein.

Detection of Single Nucleotide Variants

In some embodiments, one or more identified target sequences may be detected using guide RNAs that are specific for and bind to the target sequence as described herein. The systems and methods of the present invention can distinguish even between single nucleotide polymorphisms present among different microbial species and therefore, use of multiple guide RNAs in accordance with the invention may further expand on or improve the number of target sequences that may be used to distinguish between species. For example, in some embodiments, the one or more guide RNAs may distinguish between microbes at the species, genus, family, order, class, phylum, kingdom, or phenotype, or a combination thereof.

Detection Based on rRNA Sequences

In certain example embodiments, the devices, systems, and methods disclosed herein may be used to distinguish multiple microbial species in a sample. In certain example embodiments, identification may be based on ribosomal RNA sequences, including the 16S, 23S, and 5S subunits. Methods for identifying relevant rRNA sequences are disclosed in U.S. Patent Application Publication No. 2017/0029872. In certain example embodiments, a set of guide RNAs may be designed to distinguish each species by a variable region that is unique to each species or strain. Guide RNAs may also be designed to target RNA genes that distinguish microbes at the genus, family, order, class, phylum, or kingdom levels, or a combination thereof. In certain example embodiments where amplification is used, a set of amplification primers may be designed to flanking constant regions of the ribosomal RNA sequence and a guide RNA designed to distinguish each species by a variable internal region. In certain example embodiments, the primers and guide RNAs may be designed to conserved and variable regions in the 16S subunit respectfully. Other genes or genomic regions that are uniquely variable across species or a subset of species such as the RecA gene family, RNA polymerase β subunit, may be used as well. Other suitable phylogenetic markers, and methods for identifying the same, are discussed for example in Wu et al. arXiv:1307.8690 [q-bio.GN].

In certain example embodiments, a method or diagnostic is designed to screen microbes across multiple phylogenetic and/or phenotypic levels at the same time. For example, the method or diagnostic may comprise the use of multiple CRISPR systems with different guide RNAs. A first set of guide RNAs may distinguish, for example, between mycobacteria, gram positive, and gram negative bacteria. These general classes can be even further subdivided. For example, guide RNAs could be designed and used in the method or diagnostic that distinguish enteric and non-enteric within gram negative bacteria. A second set of guide RNAs can be designed to distinguish microbes at the genus or species level. Thus, a matrix may be produced identifying all mycobacteria, gram positive, gram negative (further divided into enteric and non-enteric) with each genus of species of bacteria identified in a given sample that fall within one of those classes. The foregoing is for example purposes only. Other means for classifying other microbe types are also contemplated and would follow the general structure described above.

Screening for Drug Resistance

In certain example embodiments, the devices, systems and methods disclosed herein may be used to screen for microbial genes of interest, for example antibiotic and/or antiviral resistance genes. Guide RNAs may be designed to distinguish between known genes of interest. Samples, including clinical samples, may then be screened using the embodiments disclosed herein for detection of such genes. The ability to screen for drug resistance at POC would have tremendous benefit in selecting an appropriate treatment regime. In certain example embodiments, the antibiotic resistance genes are carbapenemases including KPC, NDM1, CTX-M15, OXA-48. Other antibiotic resistance genes are known and may be found for example in the Comprehensive Antibiotic Resistance Database (Jia et al. "CARD 2017: expansion and model-centric curation of the Comprehensive Antibiotic Resistance Database." Nucleic Acids Research, 45, D566-573).

Ribavirin is an effective antiviral that hits a number of RNA viruses. Several clinically important viruses have evolved ribavirin resistance, including Foot and Mouth Disease Virus doi:10.1128/JVI.03594-13; polio virus (Pfeifer and Kirkegaard. PNAS, 100(12):7289-7294, 2003); and hepatitis C virus (Pfeiffer and Kirkegaard, J. Virol. 79(4): 2346-2355, 2005). A number of other persistent RNA viruses, such as hepatitis and HIV, have evolved resistance to existing antiviral drugs: hepatitis B virus (lamivudine, tenofovir, entecavir) doi:10/1002/hep22900; hepatitis C virus (telaprevir, BILN2061, ITMN-191, SCh6, boceprevir, AG-021541, ACH-806) doi:10.1002/hep.22549; and HIV (many drug resistance mutations) hivb.standford.edu. The embodiments disclosed herein may be used to detect such variants among others.

Aside from drug resistance, there are a number of clinically relevant mutations that could be detected with the embodiments disclosed herein, such as persistent versus acute infection in LCMV (doi:10.1073/pnas.1019304108), and increased infectivity of Ebola (Diehl et al. Cell. 2016, 167(4):1088-1098.

As described herein elsewhere, closely related microbial species (e.g. having only a single nucleotide difference in a given target sequence) may be distinguished by introduction of a synthetic mismatch in the gRNA.

Set Cover Approaches

In particular embodiments, a set of guide RNAs is designed that can identify, for example, all microbial species within a defined set of microbes. Such methods are described in certain example embodiments; the methods for generating guide RNAs as described herein may be compared to methods disclosed in WO 2017/040316, incorporated herein by reference. As described in WO 2017040316, a set cover solution may identify the minimal number of target sequences probes or guide RNAs needed to cover an entire target sequence or set of target sequences, e.g. a set of genomic sequences. Set cover approaches have been used previously to identify primers and/or microarray probes, typically in the 20 to 50 base pair range. See, e.g. Pearson et al., cs.virginia.edu/~robins/papers/primers_dam11_final.pdf., Jabado et al. Nucleic Acids Res. 2006 34(22):6605-11, Jabado et al. Nucleic Acids Res. 2008, 36(1):e3 doi10.1093/nar/gkm1106, Duitama et al. Nucleic Acids Res. 2009, 37(8):2483-2492, Phillippy et al. BMC Bioinformatics. 2009, 10:293 doi:10.1186/1471-2105-10-293. However, such approaches generally involved treating each primer/probe as k-mers and searching for exact matches or allowing for inexact matches using suffix arrays. In addition, the methods generally take a binary approach to detecting hybridization by selecting primers or probes such that each input sequence only needs to be bound by one primer or probe and the position of this binding along the sequence is irrelevant. Alternative methods may divide a target genome into pre-defined windows and effectively treat each window as a separate input sequence under the binary approach—i.e. they determine whether a given probe or guide RNA binds within each window and require that all of the windows be bound by the state of some probe or guide RNA. Effectively, these approaches treat each element of the "universe" in the set cover problem as being either an entire input sequence or a pre-defined window of an input sequence, and each element is considered "covered" if the start of a probe or guide RNA binds within the element. These approaches limit the fluidity to which different probe or guide RNA designs are allowed to cover a given target sequence.

In contrast, the embodiments disclosed herein are directed to detecting longer probe or guide RNA lengths, for example, in the range of 70 bp to 200 bp that are suitable for hybrid selection sequencing. In addition, the methods disclosed herein may be applied to take a pan-target sequence approach capable of defining a probe or guide RNA sets that can identify and facilitate the detection sequencing of all species and/or strain sequences in a large and/or variable target sequence set. For example, the methods disclosed herein may be used to identify all variants of a given virus, or multiple different viruses in a single assay. Further, the method disclosed herein treats each element of the "universe" in the set cover problem as being a nucleotide of a target sequence, and each element is considered "covered" as long as a probe or guide RNA binds to some segment of a target genome that includes the element. These types of set cover methods may be used instead of the binary approach of previous methods, the methods disclosed herein better model how a probe or guide RNA may hybridize to a target sequence. Rather than only asking if a given guide RNA sequence does or does not bind to a given window, such approaches may be used to detect a hybridization pattern—i.e. where a given probe or guide RNA binds to a target sequence or target sequences—and then determines from those hybridization patterns the minimum number of probes or guide RNAs needed to cover the set of target sequences to a degree sufficient to enable both enrichment from a sample and sequencing of any and all target sequences. These hybridization patterns may be determined by defining certain parameters that minimize a loss function, thereby enabling identification of minimal probe or guide RNA sets in a way that allows parameters to vary for each species, e.g. to reflect the diversity of each species, as well as in a computationally efficient manner that cannot be achieved using a straightforward application of a set cover solution, such as those previously applied in the probe or guide RNA design context.

The ability to detect multiple transcript abundances may allow for the generation of unique microbial signatures indicative of a particular phenotype. Various machine learning techniques may be used to derive the gene signatures. Accordingly, the guide RNAs of the CRISPR systems may be used to identify and/or quantitate relative levels of biomarkers defined by the gene signature in order to detect certain phenotypes. In certain example embodiments, the gene signature indicates susceptibility to an antibiotic, resistance to an antibiotic, or a combination thereof.

In one aspect of the invention, a method comprises detecting one or more pathogens. In this manner, differentiation between infection of a subject by individual microbes may be obtained. In some embodiments, such differentiation may enable detection or diagnosis by a clinician of specific diseases, for example, different variants of a disease. Preferably the pathogen sequence is a genome of the pathogen or a fragment thereof. The method further may comprise determining the evolution of the pathogen. Determining the evolution of the pathogen may comprise identification of pathogen mutations, e.g. nucleotide deletion, nucleotide insertion, nucleotide substitution. Amongst the latter, there are non-synonymous, synonymous, and noncoding substitutions. Mutations are more frequently non-synonymous during an outbreak. The method may further comprise determining the substitution rate between two pathogen sequences analyzed as described above. Whether the mutations are deleterious or even adaptive would require functional analysis, however, the rate of non-synonymous mutations suggests that continued progression of this epidemic could afford an opportunity for pathogen adaptation, underscoring the need for rapid containment. Thus, the method may further comprise assessing the risk of viral adaptation, wherein the number non-synonymous mutations is determined (Gire, et al., *Science* 345, 1369, 2014).

Monitoring Microbe Outbreaks

In some embodiments, a CRISPR system or methods of use thereof as described herein may be used to determine the evolution of a pathogen outbreak. The method may comprise detecting one or more target sequences from a plurality of samples from one or more subjects, wherein the target sequence is a sequence from a microbe causing the outbreaks. Such a method may further comprise determining a pattern of pathogen transmission, or a mechanism involved in a disease outbreak caused by a pathogen.

The pattern of pathogen transmission may comprise continued new transmissions from the natural reservoir of the pathogen or subject-to-subject transmissions (e.g. human-to-human transmission) following a single transmission from the natural reservoir or a mixture of both. In one embodiment, the pathogen transmission may be bacterial or viral transmission, in such case, the target sequence is preferably a microbial genome or fragments thereof. In one embodiment, the pattern of the pathogen transmission is the early pattern of the pathogen transmission, i.e. at the beginning of the pathogen outbreak. Determining the pattern of the pathogen transmission at the beginning of the outbreak increases likelihood of stopping the outbreak at the earliest possible time thereby reducing the possibility of local and international dissemination.

Determining the pattern of the pathogen transmission may comprise detecting a pathogen sequence according to the methods described herein. Determining the pattern of the pathogen transmission may further comprise detecting shared intra-host variations of the pathogen sequence between the subjects and determining whether the shared intra-host variations show temporal patterns. Patterns in observed intrahost and interhost variation provide important insight about transmission and epidemiology (Gire, et al., 2014).

Detection of shared intra-host variations between the subjects that show temporal patterns is an indication of transmission links between subjects (in particular between humans) because it can be explained by subject infection from multiple sources (superinfection), sample contamination recurring mutations (with or without balancing selection to reinforce mutations), or co-transmission of slightly divergent viruses that arose by mutation earlier in the transmission chain (Park, et al., *Cell* 161(7):1516-1526, 2015). Detection of shared intra-host variations between subjects may comprise detection of intra-host variants located at common single nucleotide polymorphism (SNP) positions. Positive detection of intra-host variants located at common (SNP) positions is indicative of superinfection and contamination as primary explanations for the intra-host variants. Superinfection and contamination can be parted on the basis of SNP frequency appearing as inter-host variants (Park, et al., 2015). Otherwise superinfection and contamination can be ruled out. In this latter case, detection of shared intra-host variations between subjects may further comprise assessing the frequencies of synonymous and nonsynonymous variants and comparing the frequency of synonymous and nonsynonymous variants to one another. A nonsynonymous mutation is a mutation that alters the amino acid of the protein, likely resulting in a biological change in the microbe that is subject to natural selection. Synonymous substitution does not alter an amino acid sequence. Equal frequency of synonymous and nonsynonymous variants is indicative of the intra-host variants evolving neutrally. If frequencies of synonymous and nonsynonymous variants are divergent, the intra-host variants are likely to be maintained by balancing selection. If frequencies of synonymous and nonsynonymous variants are low, this is indicative of recurrent mutation. If frequencies of synonymous and nonsynonymous variants are high, this is indicative of co-transmission (Park, et al., 2015).

Like Ebola virus, Lassa virus (LASV) can cause hemorrhagic fever with high case fatality rates. Andersen et al. generated a genomic catalog of almost 200 LASV sequences from clinical and rodent reservoir samples (Andersen, et al., Cell Volume 162, Issue 4, p 738-750, 13 Aug. 2015). Andersen et al. show that whereas the 2013-2015 EVD epidemic is fueled by human-to-human transmissions, LASV infections mainly result from reservoir-to-human infections. Andersen et al. elucidated the spread of LASV across West Africa and show that this migration was accompanied by changes in LASV genome abundance, fatality rates, codon adaptation, and translational efficiency. The method may further comprise phylogenetically comparing a first pathogen sequence to a second pathogen sequence, and determining whether there is a phylogenetic link between the first and second pathogen sequences. The second pathogen sequence may be an earlier reference sequence. If there is a phylogenetic link, the method may further comprise rooting the phylogeny of the first pathogen sequence to the second pathogen sequence. Thus, it is possible to construct the lineage of the first pathogen sequence (Park, et al., 2015).

The method may further comprise determining whether the mutations are deleterious or adaptive. Deleterious mutations are indicative of transmission-impaired viruses and dead-end infections, thus normally only present in an individual subject. Mutations unique to one individual subject are those that occur on the external branches of the phylogenetic tree, whereas internal branch mutations are those present in multiple samples (i.e. in multiple subjects). Higher rate of nonsynonymous substitution is a characteristic of external branches of the phylogenetic tree (Park, et al., 2015).

In internal branches of the phylogenetic tree, selection has had more opportunity to filter out deleterious mutants. Internal branches, by definition, have produced multiple descendent lineages and are thus less likely to include mutations with fitness costs. Thus, lower rate of nonsynonymous substitution is indicative of internal branches (Park, et al., 2015).

Synonymous mutations, which likely have less impact on fitness, occurred at more comparable frequencies on internal and external branches (Park, et al., 2015).

By analyzing the sequenced target sequence, such as viral genomes, it is possible to discover the mechanisms responsible for the severity of the epidemic episode such as during the 2014 Ebola outbreak. For example, Gire et al. made a phylogenetic comparison of the genomes of the 2014 outbreak to all 20 genomes from earlier outbreaks, which suggests that the 2014 West African virus likely spread from central Africa within the past decade. Rooting the phylogeny using divergence from other ebolavirus genomes was problematic (6, 13). However, rooting the tree on the oldest outbreak revealed a strong correlation between sample date and root-to-tip distance, with a substitution rate of 8×10-4 per site per year (13). This suggests that the lineages of the three most recent outbreaks all diverged from a common ancestor at roughly the same time, around 2004, which supports the hypothesis that each outbreak represents an independent zoonotic event from the same genetically diverse viral population in its natural reservoir. They also found out that the 2014 EBOV outbreak might be caused by a single transmission from the natural reservoir, followed by human-to-human transmission during the outbreak. Their results also suggested that the epidemic episode in Sierra Leone might stem from the introduction of two genetically distinct viruses from Guinea around the same time (Gire, et al., 2014).

It has been also possible to determine how the Lassa virus spread out from its origin point, in particular thanks to human-to-human transmission; and it was even possible to retrace the history of this spread 400 years back (Andersen, et al., Cell 162(4):738-50, 2015).

In relation to the work needed during the 2013-2015 EBOV outbreak and the difficulties encountered by the medical staff at the site of the outbreak, and more generally, the method of the invention makes it possible to carry out sequencing using fewer selected probes such that sequencing can be accelerated, thus shortening the time needed from sample taking to results procurement. Further, kits and systems can be designed to be usable on the field so that diagnostics of a patient can be readily performed without need to send or ship samples to another part of the country or the world.

In any method described above, sequencing the target sequence or fragment thereof may use any of the sequencing processes described above. Further, sequencing the target sequence or fragment thereof may be a near-real-time sequencing. Sequencing the target sequence or fragment thereof may be carried out according to previously described methods (Experimental Procedures: Matranga et al., 2014; and Gire, et al., 2014). Sequencing the target sequence or fragment thereof may comprise parallel sequencing of a plurality of target sequences. Sequencing the target sequence or fragment thereof may comprise Illumina sequencing.

Analyzing the target sequence or fragment thereof that hybridizes to one or more of the selected probes may be an identifying analysis, wherein hybridization of a selected probe to the target sequence or a fragment thereof indicates the presence of the target sequence within the sample.

Currently, primary diagnostics are based on the symptoms a patient has. However, various diseases may share identical symptoms so that diagnostics rely much on statistics. For example, malaria triggers flu-like symptoms: headache, fever, shivering, joint pain, vomiting, hemolytic anemia, jaundice, hemoglobin in the urine, retinal damage, and convulsions. These symptoms are also common for septicemia, gastroenteritis, and viral diseases. Amongst the latter, Ebola hemorrhagic fever has the following symptoms: fever, sore throat, muscular pain, headaches, vomiting, diarrhea, rash, decreased function of the liver and kidneys, internal and external hemorrhage.

When a patient is presented to a medical unit, for example in tropical Africa, basic diagnostics will conclude to malaria because statistically, malaria is the most probable disease within that region of Africa. The patient is consequently treated for malaria although the patient might not actually have contracted the disease, and the patient ends up not being correctly treated. This lack of correct treatment can be life-threatening, especially when the disease the patient contracted presents a rapid evolution. It might be too late before the medical staff realizes that the treatment given to the patient is ineffective and comes to the correct diagnostics and administers the adequate treatment to the patient.

The method of the invention provides a solution to this situation. Indeed, because the number of guide RNAs can be dramatically reduced, this makes it possible to provide on a single chip, selected probes divided into groups, each group being specific to one disease, such that a plurality of diseases, e.g. viral infection, can be diagnosed at the same time. Thanks to the invention, more than 3 diseases can be diagnosed on a single chip, preferably more than 4, 5, 6, 7, 8, 9, 10, 11, 12, 13, 14, 15, 16, 17, 18, 19, 20 diseases at the same time, preferably the diseases that most commonly occur within the population of a given geographical area. Since each group of selected probes is specific to one of the diagnosed diseases, a more accurate diagnosis can be performed, thus diminishing the risk of administering the wrong treatment to the patient.

In other cases, a disease such as a viral infection may occur without any symptoms, or has caused symptoms but they faded out before the patient is presented to the medical staff. In such cases, either the patient does not seek any medical assistance or the diagnosis is complicated due to the absence of symptoms on the day of the presentation.

The present invention may also be used in concert with other methods of diagnosing disease, identifying pathogens and optimizing treatment based upon detection of nucleic acids, such as mRNA in crude, non-purified samples.

The method of the invention also provides a powerful tool to address this situation. Indeed, since a plurality of groups of selected guide RNAs, each group being specific to one of the most common diseases that occur within the population of the given area, are comprised within a single diagnostic, the medical staff only need to contact a biological sample taken from the patient with the chip. Reading the chip reveals the diseases the patient has contracted.

In some cases, the patient is presented to the medical staff for diagnostics of particular symptoms. The method of the invention makes it possible not only to identify which disease causes these symptoms but at the same time determine whether the patient suffers from another disease he was not aware of.

This information might be of utmost importance when searching for the mechanisms of an outbreak. Indeed, groups of patients with identical viruses also show temporal patterns suggesting a subject-to-subject transmission link.

Screening Microbial Genetic Perturbations

In certain example embodiments, the CRISPR systems disclosed herein may be used to screen microbial genetic perturbations. Such methods may be useful, for example to map out microbial pathways and functional networks. Microbial cells may be genetically modified and then screened under different experimental conditions. As described above, the embodiments disclosed herein can screen for multiple target molecules in a single sample, or a single target in a single individual discrete volume in a multiplex fashion. Genetically modified microbes may be modified to include a nucleic acid barcode sequence that identifies the particular genetic modification carried by a particular microbial cell or population of microbial cells. A barcode is a short sequence of nucleotides (for example, DNA, RNA, or combinations thereof) that is used as an identifier. A nucleic acid barcode may have a length of 4-100 nucleotides and be either single or double-stranded. Methods for identifying cells with barcodes are known in the art. Accordingly, guide RNAs of the CRISPR effector systems described herein may be used to detect the barcode. Detection of the positive detectable signal indicates the presence of a particular genetic modification in the sample. The methods disclosed herein may be combined with other methods for detecting complimentary genotype or phenotypic readouts indicating the effect of the genetic modification under the experimental conditions tested. Genetic modifications to be screened may include, but are not limited to a gene knock-in, a gene knock-out, inversions, translocations, transpositions, or one or more nucleotide insertions, deletions, substitutions, mutations, or addition of nucleic acids encoding an epitope with a functional consequence such as altering protein stability or detection. In a similar fashion, the methods described herein may be used in synthetic biology application to screen the functionality of specific arrangements of gene regulatory elements and gene expression modules.

In certain example embodiments, the methods may be used to screen hypomorphs. Generation of hypomorphs and their use in identifying key bacterial functional genes and identification of new antibiotic therapeutics as disclosed in PCT/US2016/060730 entitled "Multiplex High-Resolution Detection of Micro-organism Strains, Related Kits, Diagnostic Methods and Screening Assays" filed Nov. 4, 2016, which is incorporated herein by reference.

The different experimental conditions may comprise exposure of the microbial cells to different chemical agents, combinations of chemical agents, different concentrations of chemical agents or combinations of chemical agents, different durations of exposure to chemical agents or combinations of chemical agents, different physical parameters, or both. In certain example embodiments, the chemical agent is an antibiotic or antiviral. Different physical parameters to be screened may include different temperatures, atmospheric pressures, different atmospheric and non-atmospheric gas concentrations, different pH levels, different culture media compositions, or a combination thereof.

Screening Environmental Samples

The methods disclosed herein may also be used to screen environmental samples for contaminants by detecting the presence of target nucleic acid or polypeptides. For example, in some embodiments, the invention provides a method of detecting microbes, comprising: exposing a CRISPR system as described herein to a sample; activating an RNA effector protein via binding of one or more guide RNAs to one or more microbe-specific target RNAs or one or more trigger RNAs such that a detectable positive signal is produced. The positive signal can be detected and is indicative of the presence of one or more microbes in the sample. In some embodiments, the CRISPR system may be on a substrate as described herein, and the substrate may be exposed to the sample. In other embodiments, the same CRISPR system, and/or a different CRISPR system may be applied to multiple discrete locations on the substrate. In further embodiments, the different CRISPR system may detect a different microbe at each location. As described in further detail above, a substrate may be a flexible materials substrate, for example, including, but not limited to, a paper substrate, a fabric substrate, or a flexible polymer-based substrate.

In accordance with the invention, the substrate may be exposed to the sample passively, by temporarily immersing the substrate in a fluid to be sampled, by applying a fluid to be tested to the substrate, or by contacting a surface to be tested with the substrate. Any means of introducing the sample to the substrate may be used as appropriate.

As described herein, a sample for use with the invention may be a biological or environmental sample, such as a food sample (fresh fruits or vegetables, meats), a beverage sample, a paper surface, a fabric surface, a metal surface, a wood surface, a plastic surface, a soil sample, a freshwater sample, a wastewater sample, a saline water sample, exposure to atmospheric air or other gas sample, or a combination thereof. For example, household/commercial/industrial surfaces made of any materials including, but not limited to, metal, wood, plastic, rubber, or the like, may be swabbed and tested for contaminants. Soil samples may be tested for the presence of pathogenic bacteria or parasites, or other microbes, both for environmental purposes and/or for human, animal, or plant disease testing. Water samples such as freshwater samples, wastewater samples, or saline water samples can be evaluated for cleanliness and safety, and/or potability, to detect the presence of, for example, *Cryptosporidium parvum, Giardia lamblia*, or other microbial contamination. In further embodiments, a biological sample may be obtained from a source including, but not limited to, a tissue sample, saliva, blood, plasma, sera, stool, urine, sputum, mucous, lymph, synovial fluid, cerebrospinal fluid, ascites, pleural effusion, seroma, pus, or swab of skin or a mucosal membrane surface. In some particular embodiments, an environmental sample or biological samples may be crude samples and/or the one or more target molecules may not be purified or amplified from the sample prior to application of the method. Identification of microbes may be useful and/or needed for any number of applications, and thus any type of sample from any source deemed appropriate by one of skill in the art may be used in accordance with the invention.

In some embodiments, checking for food contamination by bacteria, such as *E. coli*, in restaurants or other food providers; food surfaces; testing water for pathogens like *Salmonella, Campylobacter*, or *E. coli*; also checking food quality for manufacturers and regulators to determine the purity of meat sources; identifying air contamination with pathogens such as legionella; checking whether beer is contaminated or spoiled by pathogens like *Pediococcus* and *Lactobacillus*; contamination of pasteurized or un-pasteurized cheese by bacteria or fungi during manufacture.

A microbe in accordance with the invention may be a pathogenic microbe or a microbe that results in food or consumable product spoilage. A pathogenic microbe may be pathogenic or otherwise undesirable to humans, animals, or plants. For human or animal purposes, a microbe may cause a disease or result in illness. Animal or veterinary applications of the present invention may identify animals infected with a microbe. For example, the methods and systems of the invention may identify companion animals with pathogens including, but not limited to, kennel cough, rabies virus, and heartworms. In other embodiments, the methods and systems of the invention may be used for parentage testing for breeding purposes. A plant microbe may result in harm or disease to a plant, reduction in yield, or alter traits such as color, taste, consistency, odor. For food or consumable contamination purposes, a microbe may adversely affect the taste, odor, color, consistency or other commercial properties of the food or consumable product. In certain example embodiments, the microbe is a bacterial species. The bacteria may be a psychrotroph, a coliform, a lactic acid bacteria, or a spore-forming bacterium. In certain example embodiments, the bacterium may be any bacterial species that causes disease or illness, or otherwise results in an unwanted product or trait. Bacteria in accordance with the invention may be pathogenic to humans, animals, or plants.

Sample Types

Appropriate samples for use in the methods disclosed herein include any conventional biological sample obtained from an organism or a part thereof, such as a plant, animal, bacteria, and the like. In particular embodiments, the biological sample is obtained from an animal subject, such as a human subject. A biological sample is any solid or fluid sample obtained from, excreted by or secreted by any living organism, including, without limitation, single celled organisms, such as bacteria, yeast, protozoans, and amoebas among others, multicellular organisms (such as plants or animals, including samples from a healthy or apparently healthy human subject or a human patient affected by a condition or disease to be diagnosed or investigated, such as an infection with a pathogenic microorganism, such as a pathogenic bacterium or virus). For example, a biological sample can be a biological fluid obtained from, for example, blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface.

A sample can also be a sample obtained from any organ or tissue (including a biopsy or autopsy specimen, such as a tumor biopsy) or can include a cell (whether a primary cell or cultured cell) or medium conditioned by any cell, tissue or organ. Exemplary samples include, without limitation, cells, cell lysates, blood smears, cytocentrifuge preparations, cytology smears, bodily fluids (e.g., blood, plasma, serum, saliva, sputum, urine, bronchoalveolar lavage, semen, etc.), tissue biopsies (e.g., tumor biopsies), fine-needle aspirates, and/or tissue sections (e.g., cryostat tissue sections and/or paraffin-embedded tissue sections). In other examples, the sample includes circulating tumor cells (which can be identified by cell surface markers). In particular examples, samples are used directly (e.g., fresh or frozen), or can be manipulated prior to use, for example, by fixation (e.g., using formalin) and/or embedding in wax (such as formalin-fixed paraffin-embedded (FFPE) tissue samples). It will be appreciated that any method of obtaining tissue from a subject can be utilized, and that the selection of the method used will depend upon various factors such as the type of tissue, age of the subject, or procedures available to the practitioner. Standard techniques for acquisition of such samples are available in the art. See, for example Schluger et al., *J. Exp. Med.* 176:1327-33 (1992); Bigby et al., *Am. Rev. Respir. Dis.* 133:515-18 (1986); Kovacs et al., *NEJM* 318:589-93 (1988); and Ognibene et al., *Am. Rev. Respir. Dis.* 129:929-32 (1984).

In other embodiments, a sample may be an environmental sample, such as water, soil, or a surface such as industrial or medical surface. In some embodiments, methods such as those disclosed in US patent publication No. 2013/0190196 may be applied for detection of nucleic acid signatures, specifically RNA levels, directly from crude cellular samples with a high degree of sensitivity and specificity. Sequences specific to each pathogen of interest may be identified or selected by comparing the coding sequences from the pathogen of interest to all coding sequences in other organisms by BLAST software.

Several embodiments of the present disclosure involve the use of procedures and approaches known in the art to successfully fractionate clinical blood samples. See, e.g. the procedure described in Han Wei Hou et al., *Microfluidic Devices for Blood Fractionation*, Micromachines 2011, 2, 319-343; Ali Asgar S. Bhagat et al., *Dean Flow Fractionation (DFF) Isolation of Circulating Tumor Cells (CTCs) from Blood,* 15th International Conference on Miniaturized Systems for Chemistry and Life Sciences, Oct. 2-6, 2011, Seattle, Wash.; and International Patent Publication No. WO2011109762, the disclosures of which are herein incorporated by reference in their entirety. Blood samples are commonly expanded in culture to increase sample size for testing purposes. In some embodiments of the present invention, blood or other biological samples may be used in methods as described herein without the need for expansion in culture.

Further, several embodiments of the present disclosure involve the use of procedures and approaches known in the art to successfully isolate pathogens from whole blood using spiral microchannel, as described in Han Wei Hou et al., Pathogen Isolation from Whole Blood Using Spiral Microchannel, Case No. 15995JR, Massachusetts Institute of Technology, manuscript in preparation, the disclosure of which is herein incorporated by reference in its entirety.

Owing to the increased sensitivity of the embodiments disclosed herein, in certain example embodiments, the assays and methods may be run on crude samples or samples where the target molecules to be detected are not further fractionated or purified from the sample.

Example Microbes

The embodiment disclosed herein may be used to detect a number of different microbes. The term microbe as used herein includes bacteria, fungi, protozoa, parasites and viruses.

Bacteria

The following provides an example list of the types of microbes that might be detected using the embodiments disclosed herein. In certain example embodiments, the microbe is a bacterium. Examples of bacteria that can be detected in accordance with the disclosed methods include without limitation any one or more of (or any combination of) *Acinetobacter baumanii, Actinobacillus* sp., *Actinomycetes, Actinomyces* sp. (such as *Actinomyces israelii* and *Actinomyces naeslundii*), *Aeromonas* sp. (such as *Aeromo-* nas hydrophila, Aeromonas veronii biovar sobria (Aeromonas sobria), and Aeromonas caviae), Anaplasma phagocytophilum, Anaplasma marginate Alcaligenes xylosoxidans, Acinetobacter baumanii, Actinobacillus actinomycetemcomitans, Bacillus sp. (such as Bacillus anthracis, Bacillus cereus, Bacillus subtilis, Bacillus thuringiensis, and Bacillus stearothermophilus), Bacteroides sp. (such as Bacteroides fragilis), Bartonella sp. (such as Bartonella bacilliformis and Bartonella henselae, Bifidobacterium sp., Bordetella sp. (such as Bordetella pertussis, Bordetella parapertussis, and Bordetella bronchiseptica), Borrelia sp. (such as Borrelia recurrentis, and Borrelia burgdorferi), Brucella sp. (such as Brucella abortus, Brucella canis, Brucella melintensis and Brucella suis), Burkholderia sp. (such as Burkholderia pseudomallei and Burkholderia cepacia), Campylobacter sp. (such as Campylobacter jejuni, Campylobacter coli, Campylobacter lari and Campylobacter fetus), Capnocytophaga sp., Cardiobacterium hominis, Chlamydia trachomatis, Chlamydophila pneumoniae, Chlamydophila psittaci, Citrobacter sp. Coxiella burnetii, Corynebacterium sp. (such as, Corynebacterium diphtherias, Corynebacterium jeikeum and Corynebacterium), Clostridium sp. (such as Clostridium perfringens, Clostridium difficile, Clostridium botulinum and Clostridium tetani), Eikenella corrodens, Enterobacter sp. (such as Enterobacter aerogenes, Enterobacter agglomerans, Enterobacter cloacae and Escherichia coli, including opportunistic Escherichia coli, such as enterotoxigenic E. coli, enteroinvasive E. coli, enteropathogenic E. coli, enterohemorrhagic E. coli, enteroaggregative E. coli and uropathogenic E. coli) Enterococcus sp. (such as Enterococcus faecalis and Enterococcus faecium) Ehrlichia sp. (such as Ehrlichia chafeensia and Ehrlichia canis), Epidermophyton floccosum, Erysipelothrix rhusiopathiae, Eubacterium sp., Francisella tularensis, Fusobacterium nucleatum, Gardnerella vaginalis, Gemella morbillorum, Haemophilus sp. (such as Haemophilus influenzae, Haemophilus ducreyi, Haemophilus aegyptius, Haemophilus parainfluenzae, Haemophilus haemolyticus and Haemophilus parahaemolyticus, Helicobacter sp. (such as Helicobacter pylori, Helicobacter cinaedi and Helicobacter fennelliae), Kingella kingii, Klebsiella sp. (such as Klebsiella pneumoniae, Klebsiella granulomatis and Klebsiella oxytoca), Lactobacillus sp., Listeria monocytogenes, Leptospira interrogans, Legionella pneumophila, Leptospira interrogans, Peptostreptococcus sp., Mannheimia hemolytica, Microsporum canis, Moraxella catarrhalis, Morganella sp., Mobiluncus sp., Micrococcus sp., Mycobacterium sp. (such as Mycobacterium leprae, Mycobacterium tuberculosis, Mycobacterium paratuberculosis, Mycobacterium intracellulare, Mycobacterium avium, Mycobacterium bovis, and Mycobacterium marinum), Mycoplasm sp. (such as Mycoplasma pneumoniae, Mycoplasma hominis, and Mycoplasma genitalium), Nocardia sp. (such as Nocardia asteroides, Nocardia cyriacigeorgica and Nocardia brasiliensis), Neisseria sp. (such as Neisseria gonorrhoeae and Neisseria meningitidis), Pasteurella multocida, Pityrosporum orbiculare (Malassezia furfur), Plesiomonas shigelloides. Prevotella sp., Porphyromonas sp., Prevotella melaninogenica, Proteus sp. (such as Proteus vulgaris and Proteus mirabilis), Providencia sp. (such as Providencia alcalifaciens, Providencia rettgeri and Providencia stuartii), Pseudomonas aeruginosa, Propionibacterium acnes, Rhodococcus equi, Rickettsia sp. (such as Rickettsia rickettsii, Rickettsia akari and Rickettsia prowazekii, Orientia tsutsugamushi (formerly: Rickettsia tsutsugamushi) and Rickettsia typhi), Rhodococcus sp., Serratia marcescens, Stenotrophomonas maltophilia, Salmonella sp. (such as Salmonella enterica, Salmonella typhi, Salmonella paratyphi, Salmonella enteritidis, Salmonella cholerasuis and Salmonella typhimurium), Serratia sp. (such as Serratia marcesans and Serratia liquifaciens), Shigella sp. (such as Shigella dysenteriae, Shigella flexneri, Shigella boydii and Shigella sonnei), Staphylococcus sp. (such as Staphylococcus aureus, Staphylococcus epidermidis, Staphylococcus hemolyticus, Staphylococcus saprophyticus), Streptococcus sp. (such as Streptococcus pneumoniae (for example chloramphenicol-resistant serotype 4 Streptococcus pneumoniae, spectinomycin-resistant serotype 6B Streptococcus pneumoniae, streptomycin-resistant serotype 9V Streptococcus pneumoniae, erythromycin-resistant serotype 14 Streptococcus pneumoniae, optochin-resistant serotype 14 Streptococcus pneumoniae, rifampicin-resistant serotype 18C Streptococcus pneumoniae, tetracycline-resistant serotype 19F Streptococcus pneumoniae, penicillin-resistant serotype 19F Streptococcus pneumoniae, and trimethoprim-resistant serotype 23F Streptococcus pneumoniae, chloramphenicol-resistant serotype 4 Streptococcus pneumoniae, spectinomycin-resistant serotype 6B Streptococcus pneumoniae, streptomycin-resistant serotype 9V Streptococcus pneumoniae, optochin-resistant serotype 14 Streptococcus pneumoniae, rifampicin-resistant serotype 18C Streptococcus pneumoniae, penicillin-resistant serotype 19F Streptococcus pneumoniae, or trimethoprim-resistant serotype 23F Streptococcus pneumoniae), Streptococcus agalactiae, Streptococcus mutans, Streptococcus pyogenes, Group A streptococci, Streptococcus pyogenes, Group B streptococci, Streptococcus agalactiae, Group C streptococci, Streptococcus anginosus, Streptococcus equismilis, Group D streptococci, Streptococcus bovis, Group F streptococci, and Streptococcus anginosus Group G streptococci), Spirillum minus, Streptobacillus moniliformi, Treponema sp. (such as Treponema carateum, Treponema petenue, Treponema pallidum and Treponema endemicum, Trichophyton rubrum, T mentagrophytes, Tropheryma whippelii, Ureaplasma urealyticum, Veillonella sp., Vibrio sp. (such as Vibrio cholerae, Vibrio parahemolyticus, Vibrio vulnificus, Vibrio parahaemolyticus, Vibrio vulnificus, Vibrio alginolyticus, Vibrio mimicus, Vibrio hollisae, Vibrio fluvialis, Vibrio metchnikovii, Vibrio damsela and Vibrio furnisii), Yersinia sp. (such as Yersinia enterocolitica, Yersinia pestis, and Yersinia pseudotuberculosis) and Xanthomonas maltophilia among others.

Fungi

In certain example embodiments, the microbe is a fungus or a fungal species. Examples of fungi that can be detected in accordance with the disclosed methods include without limitation any one or more of (or any combination of), Aspergillus, Blastomyces, Candidiasis, Coccidiodomycosis, Cryptococcus neoformans, Cryptococcus gatti, sp. Histoplasma sp. (such as Histoplasma capsulatum), Pneumocystis sp. (such as Pneumocystis jirovecii), Stachybotrys (such as Stachybotrys chartarum), Mucroymcosis, Sporothrix, fungal eye infections ringworm, Exserohilum, Cladosporium.

In certain example embodiments, the fungus is a yeast. Examples of yeast that can be detected in accordance with disclosed methods include without limitation one or more of (or any combination of), Aspergillus species (such as Aspergillus fumigatus, Aspergillus flavus and Aspergillus clavatus), Cryptococcus sp. (such as Cryptococcus neoformans, Cryptococcus gattii, Cryptococcus laurentii and Cryptococcus albidus), a Geotrichum species, a Saccharomyces species, a Hansenula species, a Candida species (such as Candida albicans), a Kluyveromyces species, a Debaryomyces species, a Pichia species, or combination thereof. In certain example embodiments, the fungus is a mold.

Example molds include, but are not limited to, a *Penicillium* species, a *Cladosporium* species, a *Byssochlamys* species, or a combination thereof.

Protozoa

In certain example embodiments, the microbe is a protozoan. Examples of protozoa that can be detected in accordance with the disclosed methods and devices include without limitation any one or more of (or any combination of), *Euglenozoa, Heterolobosea, Diplomonadida, Amoebozoa, Blastocystic*, and *Apicomplexa*. Example *Euglenoza* include, but are not limited to, *Trypanosoma cruzi* (Chagas disease), *T. brucei gambiense, T. brucei rhodesiense, Leishmania braziliensis, L. infantum, L. mexicana, L. major, L. tropica*, and *L. donovani*. Example *Heterolobosea* include, but are not limited to, *Naegleria fowleri*. Example Diplomonadid include, but are not limited to, *Giardia intestinalis* (*G. lamblia, G. duodenalis*). Example *Amoebozoa* include, but are not limited to, *Acanthamoeba castellanii, Balamuthia madrillaris, Entamoeba histolytica*. Example *Blastocystis* include, but are not limited to, *Blastocystic hominis*. Example *Apicomplexa* include, but are not limited to, *Babesia microti, Cryptosporidium parvum, Cyclospora cayetanensis, Plasmodium falciparum, P. vivax, P. ovale, P. malariae*, and *Toxoplasma gondii, Babesia microti, Cryptosporidium parvum, Cyclospora cayetanensis, Plasmodium falciparum, P. vivax, P. ovale, P. malariae*, and *Toxoplasma gondii*.

Parasites

In certain example embodiments, the microbe is a parasite. Examples of parasites that can be detected in accordance with disclosed methods include without limitation one or more of (or any combination of), an *Onchocerca* species and a *Plasmodium* species.

Viruses

In certain example embodiments, the systems, devices, and methods disclosed herein are directed to detecting viruses in a sample. The embodiments disclosed herein may be used to detect viral infection (e.g. of a subject or plant), or determination of a viral strain, including viral strains that differ by a single nucleotide polymorphism. The virus may be a DNA virus, an RNA virus, or a retrovirus. Non-limiting examples of viruses useful with the present invention include, but are not limited to Ebola, measles, SARS, Chikungunya, hepatitis, Marburg, yellow fever, MERS, Dengue, Lassa, influenza, rhabdovirus or HIV. A hepatitis virus may include hepatitis A, hepatitis B, or hepatitis C. An influenza virus may include, for example, influenza A or influenza B. An HIV may include HIV 1 or HIV 2. In certain example embodiments, the viral sequence may be a human respiratory syncytial virus, Sudan ebola virus, Bundibugyo virus, Tai Forest ebola virus, Reston ebola virus, Achimota, Aedes flavivirus, Aguacate virus, Akabane virus, Alethinophid reptarenavirus, Allpahuayo mammarenavirus, Amapari mmarenavirus, Andes virus, Apoi virus, Aravan virus, Aroa virus, Arumwot virus, Atlantic salmon paramyoxivirus, Australian bat lyssavirus, Avian bornavirus, Avian metapneumovirus, Avian paramyoxviruses, penguin or Falkland Islandsvirus, BK polyomavirus, Bagaza virus, Banna virus, Bat hepevirus, Bat sapovirus, Bear Canon mammarenavirus, Beilong virus, Betacoronoavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwere virus, Caliciviridae virus. California encephalitis virus, Candiru virus, Canine distemper virus, Canaine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, Culex flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyxovirus, Fitzroy River virus, Flaviviridae virus, Flexal mammarenavirus, GB virus C, Gairo virus, Gemycircularvirus, Goose paramyoxiviurs SF02, Great Island virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human gential-associated circular DNA virus-1, Human herpesvirus 1-8, Human immunodeficiency virus 1/2, Huan mastadenovirus A-G, Human papillomavirus, Human parainfluenza virus 1-4, Human paraechovirus, Human picobirnavirus, Human smacovirus, Ikoma lyssavirus, Ilheus virus, Influenza A-C, Ippy mammarenavirus, Irkut virus, J-virus, JC polyomavirus, Japanses encephalitis virus, Junin mammarenavirus, KI polyomavirus, Kadipiro virus, Kamiti River virus, Kedougou virus, Khuj and virus, Kokobera virus, Kyasanur forest disease virus, Lagos bat virus, Langat virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2\0.225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Moijang virus, Mokolo virus, Monkeypox virus, Montana myotis leukoenchalitis virus, Mopeia lassa virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichande mammarenavirus, Picornaviridae virus, Pirital mammarenavirus, Piscihepevirus A, Procine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louis encephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Togaviridae virus, Torque teno canis virus, Torque teno douroucouli virus, Torque teno felis virus, Torque teno midi virus, Torque teno sus virus, Torque teno tamarin virus, Torque teno virus, Torque teno zalophus virus, Tuhoko virus, Tula virus, Tupaia paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or *Zygosaccharomyces bailii* virus Z viral sequence. Examples of RNA viruses that may be detected include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain example embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain example embodiments, the virus may be a plant virus selected from the group comprising Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), Citrus tristeza virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), Arabis mosaic virus (ArMV), or Rupestris stem pitting-associated virus (RSPaV). In a preferred embodiment, the target RNA molecule is part of said pathogen or transcribed from a DNA molecule of said pathogen. For example, the target sequence may be comprised in the genome of an RNA virus. It is further preferred that CRISPR effector protein hydrolyzes said target RNA molecule of said pathogen in said plant if said pathogen infects or has infected said plant. It is thus preferred that the CRISPR system is capable of cleaving the target RNA molecule from the plant pathogen both when the CRISPR system (or parts needed for its completion) is applied therapeutically, i.e. after infection has occurred or prophylactically, i.e. before infection has occurred.

In certain example embodiments, the virus may be a retrovirus. Example retroviruses that may be detected using the embodiments disclosed herein include one or more of or any combination of viruses of the Genus Alpharetrovirus, Betaretrovirus, Gammaretrovirus, Deltaretrovirus, Epsilonretrovirus, Lentivirus, Spumavirus, or the Family Metaviridae, Pseudoviridae, and Retroviridae (including HIV), Hepadnaviridae (including Hepatitis B virus), and Caulimoviridae (including Cauliflower mosaic virus).

In certain example embodiments, the virus is a DNA virus. Example DNA viruses that may be detected using the embodiments disclosed herein include one or more of (or any combination of) viruses from the Family Myoviridae, Podoviridae, Siphoviridae, Alloherpesviridae, Herpesviridae (including human herpes virus, and Varicella Zorter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus, among others. In some embodiments, a method of diagnosing a species-specific bacterial infection in a subject suspected of having a bacterial infection is described as obtaining a sample comprising bacterial ribosomal ribonucleic acid from the subject; contacting the sample with one or more of the probes described, and detecting hybridization between the bacterial ribosomal ribonucleic acid sequence present in the sample and the probe, wherein the detection of hybridization indicates that the subject is infected with *Escherichia coli, Klebsiella pneumoniae, Pseudomonas aeruginosa, Staphylococcus aureus, Acinetobacter baumannii, Candida albicans, Enterobacter cloacae, Enterococcus faecalis, Enterococcus faecium, Proteus mirabilis, Staphylococcus agalactiae*, or *Staphylococcus maltophilia* or a combination thereof.

Malaria Detection and Monitoring

Malaria is a mosquito-borne pathology caused by *Plasmodium* parasites. The parasites are spread to people through the bites of infected female *Anopheles* mosquitoes. Five *Plasmodium* species cause malaria in humans: *Plasmodium falciparum, Plasmodium vivax, Plasmodium ovale, Plasmodium malariae*, and *Plasmodium knowlesi*. Among them, according to the World Health Organization (WHO), *Plasmodium falciparum* and *Plasmodium vivax* are responsible for the greatest threat. *P. falciparum* is the most prevalent malaria parasite on the African continent and is responsible for most malaria-related deaths globally. *P. vivax* is the dominant malaria parasite in most countries outside of sub-Saharan Africa.

In 2015, 91 countries and areas had ongoing malaria transmission. According to the latest WHO estimates, there were 212 million cases of malaria in 2015 and 429 000 deaths. In areas with high transmission of malaria, children under 5 are particularly susceptible to infection, illness and death; more than two thirds (70%) of all malaria deaths occur in this age group. Between 2010 and 2015, the under-5 malaria death rate fell by 29% globally. However, malaria remains a major killer of children under five years old, taking the life of a child every two minutes.

As described by the WHO, malaria is an acute febrile illness. In a non-immune individual, symptoms appear 7 days or more after the infective mosquito bite. The first symptoms—fever, headache, chills and vomiting—may be mild and difficult to recognize as malaria, however, if not treated within 24 hours, *P. falciparum* malaria can progress to severe illness, often leading to death.

Children with severe malaria frequently develop one or more of the following symptoms: severe anaemia, respiratory distress in relation to metabolic acidosis, or cerebral malaria. In adults, multi-organ involvement is also frequent.

In malaria endemic areas, people may develop partial immunity, allowing asymptomatic infections to occur.

The development of rapid and efficient diagnostic tests is of high relevance for public health. Indeed, early diagnosis and treatment of malaria not only reduces disease and prevents deaths but also contributes to reducing malaria transmission. According to the WHO recommendations, all cases of suspected malaria should be confirmed using parasite-based diagnostic testing (notably using a rapid diagnostic test) before administering treatment (see "WHO Guidelines for the treatment of malaria", third edition, published in April 2015).

Resistance to antimalarial therapies represents a critical health problem which drastically reduces therapeutic strategies. Indeed, as reported on the WHO website, resistance of *P. falciparum* to previous generations of medicines, such as chloroquine and sulfadoxine/pyrimethamine (SP), became widespread in the 1950s and 1960s, undermining malaria control efforts and reversing gains in child survival. Thus, the WHO recommends the routine monitoring of antimalarial drug resistance. Indeed, accurate diagnosis may avoid non-appropriate treatments and limit extension of resistance to antimalarial medicines.

In this context, the WHO Global Technical Strategy for Malaria 2016-2030—adopted by the World Health Assembly in May 2015—provides a technical framework for all malaria-endemic countries. It is intended to guide and support regional and country programs as they work towards malaria control and elimination. The Strategy sets ambitious but achievable global targets, including:

Reducing malaria case incidence by at least 90% by 2030.
Reducing malaria mortality rates by at least 90% by 2030.
Eliminating malaria in at least 35 countries by 2030.
Preventing a resurgence of malaria in all countries that are malaria-free.

This Strategy was the result of an extensive consultative process that spanned 2 years and involved the participation of more than 400 technical experts from 70 Member States. It is based on 3 key axes:

ensuring universal access to malaria prevention, diagnosis and treatment;
accelerating efforts towards elimination and attainment of malaria-free status; and
transforming malaria surveillance into a core intervention.

Treatment against *Plasmodium* include aryl-amino alcohols such as quinine or quinine derivatives such as chloroquine, amodiaquine, mefloquine, piperaquine, lumefantrine, primaquine; lipophilic hydroxynaphthoquinone analog, such as atovaquone; antifolate drugs, such as the sulfa drugs sulfadoxine, dapsone and pyrimethamine; proguanil; the combination of atovaquone/proguanil; atemisins drugs; and combinations thereof.

Target sequences that are diagnostic for the presence of a mosquito-borne pathogen include sequences that are diagnostic for the presence of *Plasmodium*, notably Plasmodia species affecting humans such as *Plasmodium falciparum, Plasmodium vivax, Plasmodium ovale, Plasmodium malariae*, and *Plasmodium knowlesi*, including sequences from the genomes thereof.

Target sequences that are diagnostic for monitoring drug resistance to treatment against *Plasmodium*, notably Plasmodia species affecting humans such as *Plasmodium falciparum, Plasmodium vivax, Plasmodium ovale, Plasmodium malariae*, and *Plasmodium knowlesi*.

Further target sequences include sequences include target molecules/nucleic acid molecules coding for proteins involved in essential biological processes for the *Plasmodium* parasite and notably transporter proteins, such as proteins from the drug/metabolite transporter family, the ATP-binding cassette (ABC) protein involved in substrate translocation, such as the ABC transporter C subfamily or the $Na^+/H^+$ exchanger, membrane glutathione S-transferase; proteins involved in the folate pathway, such as the dihydropteroate synthase, the dihydrofolate reductase activity or the dihydrofolate reductase-thymidylate synthase; and proteins involved in the translocation of protons across the inner mitochondrial membrane and notably the cytochrome b complex. Additional targets may also include the gene(s) coding for the heme polymerase.

Further target sequences include target molecules/nucleic acid molecules coding for proteins involved in essential biological processes that may be selected from the *P. falciparum* chloroquine resistance transporter gene (pfcrt), the *P. falciparum* multidrug resistance transporter 1 (pfmdr1), the *P. falciparum* multidrug resistance-associated protein gene (Pfmrp), the *P. falciparum* $Na^+/H^+$ exchanger gene (pfnhe), the gene coding for the *P. falciparum* exported protein 1, the *P. falciparum* Ca2+ transporting ATPase 6 (pfatp6); the *P. falciparum* dihydropteroate synthase (pfdhps), dihydrofolate reductase activity (pfdhpr) and dihydrofolate reductase-thymidylate synthase (pfdhfr) genes, the cytochrome b gene, GTP cyclohydrolase and the Kelch13 (K13) gene as well as their functional heterologous genes in other *Plasmodium* species.

A number of mutations, notably single point mutations, have been identified in the proteins which are the targets of the current treatments and associated with specific resistance phenotypes. Accordingly, the invention allows for the detection of various resistance phenotypes of mosquito-borne parasites, such as *plasmodium*.

The invention allows to detect one or more mutation(s) and notably one or more single nucleotide polymorphisms in target nucleic acids/molecules. Accordingly, any one of the mutations below, or their combination thereof, can be used as drug resistance markers and can be detected according to the invention.

Single point mutations in *P. falciparum* K13 include the following single point mutations in positions 252, 441, 446, 449, 458, 493, 539, 543, 553, 561, 568, 574, 578, 580, 675, 476, 469, 481, 522, 537, 538, 579, 584 and 719 and notably mutations E252Q, P441L, F446I, G449A, N458Y, Y493H, R539T, I543T, P553L, R561H, V568G, P574L, A578S, C580Y, A675V, M476I; C469Y; A481V; S522C; N537I; N537D; G538V; M579I; D584V; and H719N. These mutations are generally associated with artemisins drugs resistance phenotypes (Artemisinin and artemisinin-based combination therapy resistance, April 2016 WHO/HTM/GMP/2016.5).

In the *P. falciparum* dihydrofolate reductase (DHFR) (PfDHFR-TS, PFD0830w), important polymorphisms include mutations in positions 108, 51, 59 and 164, notably 108 D, 164L, 51I and 59R which modulate resistance to pyrimethamine. Other polymorphisms also include 437G, 581G, 540E, 436A and 613S which are associated with resistance to sulfadoxine. Additional observed mutations include Ser108Asn, Asn51Ile, Cys59Arg, Ile164Leu, Cys50Arg, Ile164Leu, Asn188Lys, Ser189Arg and Val213Ala, Ser108Thr and Ala16Val. Mutations Ser108Asn, Asn51Ile, Cys59Arg, Ile164Leu, Cys50Arg, Ile164Leu are notably associated with pyrimethamine based therapy and/or chloroguanine-dapsone combination therapy resistances. Cycloguanil resistance appears to be associated with the double mutations Ser108Thr and Ala16Val. Amplification of dhfr may also be of high relevance for therapy resistance, notably pyrimethamine resistance.

In the *P. falciparum* dihydropteroate synthase (DHPS) (PfDHPS, PF08_0095), important polymorphisms include mutations in positions 436, 437, 581 and 613 Ser436Ala/Phe, Ala437Gly, Lys540Glu, Ala581Gly and Ala613Thr/Ser. Polymorphisms in position 581 and/or 613 have also been associated with resistance to sulfadoxine-pyrimethamine base therapies.

In the *P. falciparum* chloroquine-resistance transporter (PfCRT), polymorphism in position 76, notably the mutation Lys76Thr, is associated with resistance to chloroquine. Further polymorphisms include Cys72Ser, Met74Ile, Asn75Glu, Ala220Ser, Gln271Glu, Asn326Ser, Ile356Thr and Arg371Ile which may be associated with chloroquine resistance. PfCRT is also phosphorylated at the residues S33, 5411 and T416, which may regulate the transport activity or specificity of the protein.

In the *P. falciparum* multidrug-resistance transporter 1 (PfMDR1) (PFE1150w), polymorphisms in positions 86, 184, 1034, 1042, notably Asn86Tyr, Tyr184-Phe, Ser1034Cys, Asn1042Asp and Asp1246Tyr have been identified and reported to influence have been reported to influence susceptibilities to lumefantrine, artemisinin, quinine, mefloquine, halofantrine and chloroquine. Additionally, amplification of PfMDR1 is associated with reduced susceptibility to lumefantrine, artemisinin, quinine, mefloquine, and halofantrine and deamplification of PfMDR1 leads to an increase in chloroquine resistance. Amplification of pfmdr1 may also be detected. The phosphorylation status of PfMDR1 is also of high relevance.

In the *P. falciparum* multidrug-resistance associated protein (PfMRP) (gene reference PFA0590w), polymorphisms in positions 191 and/or 437, such as Y191H and A437S have been identified and associated with chloroquine resistance phenotypes.

In the *P. falciparum* NA$^+$/H$^+$ enchanger (PfNHE) (ref PF13 0019), increased repetition of the DNNND in microsatellite ms4670 may be a marker for quinine resistance.

Mutations altering the ubiquinol binding site of the cytochrome b protein encoded by the cytochrome bc gene (cytb, mal_mito_3) are associated with atovaquone resistance. Mutations in positions 26, 268, 276, 133 and 280 and notably Tyr26Asn, Tyr268Ser, M133I and G280D may be associated with atovaquone resistance.

For example in P *Vivax*, mutations in PvMDR1, the homolog of Pf MDR1 have been associated with chloroquine resistance, notably polymorphism in position 976 such as the mutation Y976F.

The above mutations are defined in terms of protein sequences. However, the skilled person is able to determine the corresponding mutations, including SNPS, to be identified as a nucleic acid target sequence.

Other identified drug-resistance markers are known in the art, for example as described in "*Susceptibility of Plasmodium falciparum to antimalarial drugs (1996-2004)*", WHO; Artemisinin and artemisinin-based combination therapy resistance (April 2016 WHO/HTM/GMP/2016.5); "*Drug-resistant malaria: molecular mechanisms and implications for public health*" FEBS Lett. 2011 Jun. 6; 585(11):1551-62. doi:10.1016/j.febslet.2011.04.042. Epub 2011 Apr. 23. Review. PubMed PMID: 21530510; the contents of which are herewith incorporated by reference.

As to polypeptides that may be detected in accordance with the present invention, gene products of all genes mentioned herein may be used as targets. Correspondingly, it is contemplated that such polypeptides could be used for species identification, typing and/or detection of drug resistance.

In certain example embodiments, the systems, devices, and methods disclosed herein are directed to detecting the presence of one or more mosquito-borne parasite in a sample, such as a biological sample obtained from a subject. In certain example embodiments, the parasite may be selected from the species *Plasmodium falciparum*, *Plasmodium vivax*, *Plasmodium ovale*, *Plasmodium malariae* or *Plasmodium knowlesi*. Accordingly, the methods disclosed herein can be adapted for use in other methods (or in combination) with other methods that require quick identification of parasite species, monitoring the presence of parasites and parasite forms (for example corresponding to various stages of infection and parasite life-cycle, such as exo-erythrocytic cycle, erythrocytic cycle, sporpogonic cycle; parasite forms including merozoites, sporozoites, schizonts, gametocytes); detection of certain phenotypes (e.g. pathogen drug resistance), monitoring of disease progression and/or outbreak, and treatment (drug) screening. Further, in the case of malaria, a long time may elapse following the infective bite, namely a long incubation period, during which the patient does not show symptoms. Similarly, prophylactic treatments can delay the appearance of symptoms, and long asymptomatic periods can also be observed before a relapse. Such delays can easily cause misdiagnosis or delayed diagnosis, and thus impair the effectiveness of treatment.

Because of the rapid and sensitive diagnostic capabilities of the embodiments disclosed here, detection of parasite type, down to a single nucleotide difference, and the ability to be deployed as a POC device, the embodiments disclosed herein may be used as guide therapeutic regimens, such as selection of the appropriate course of treatment. The embodiments disclosed herein may also be used to screen environmental samples (mosquito population, etc.) for the presence and the typing of the parasite. The embodiments may also be modified to detect mosquito-borne parasistes and other mosquito-borne pathogens simultaneously. In some instances, malaria and other mosquito-borne pathogens may present initially with similar symptoms. Thus, the ability to quickly distinguish the type of infection can guide important treatment decisions. Other mosquito-borne pathogens that may be detected in conjunction with malaria include dengue, West Nile virus, chikungunya, yellow fever, filariasis, Japanese encephalitis, Saint Louis encephalitis, western equine encephalitis, eastern equine encephalitis, Venezuelan equine encephalitits, La Crosse encephalitis, and Zika.

In certain example embodiments, the devices, systems, and methods disclosed herein may be used to distinguish multiple mosquito-borne parasite species in a sample. In certain example embodiments, identification may be based on ribosomal RNA sequences, including the 18S, 16S, 23S, and 5S subunits. In certain example embodiments, identification may be based on sequences of genes that are present in multiple copies in the genome, such as mitochondrial genes like CYTB. In certain example embodiments, identification may be based on sequences of genes that are highly expressed and/or highly conserved such as GAPDH, Histone H2B, enolase, or LDH. Methods for identifying relevant rRNA sequences are disclosed in U.S. Patent Application Publication No. 2017/0029872. In certain example embodiments, a set of guide RNAs may be designed to distinguish each species by a variable region that is unique to each species or strain.

Guide RNAs may also be designed to target RNA genes that distinguish microbes at the genus, family, order, class, phylum, kingdom levels, or a combination thereof. In certain example embodiments where amplification is used, a set of amplification primers may be designed to flanking constant regions of the ribosomal RNA sequence and a guide RNA designed to distinguish each species by a variable internal region. In certain example embodiments, the primers and guide RNAs may be designed to conserved and variable regions in the 16S subunit respectfully. Other genes or genomic regions that are uniquely variable across species or a subset of species such as the RecA gene family, RNA polymerase β subunit, may be used as well. Other suitable phylogenetic markers, and methods for identifying the same, are discussed for example in Wu et al. arXiv:1307.8690 [q-bio.GN].

In certain example embodiments, species identification can be performed based on genes that are present in multiple copies in the genome, such as mitochondrial genes like CYTB. In certain example embodiments, species identification can be performed based on highly expressed and/or highly conserved genes such as GAPDH, Histone H2B, enolase, or LDH.

In certain example embodiments, a method or diagnostic is designed to screen mosquito-borne parasites across multiple phylogenetic and/or phenotypic levels at the same time. For example, the method or diagnostic may comprise the use of multiple CRISPR systems with different guide RNAs. A first set of guide RNAs may distinguish, for example, between *Plasmodium falciparum* or *Plasmodium vivax*. These general classes can be even further subdivided. For example, guide RNAs could be designed and used in the method or diagnostic that distinguish drug-resistant strains, in general or with respect to a specific drug or combination of drugs. A second set of guide RNAs can be designed to distinguish microbes at the species level. Thus, a matrix may be produced identifying all mosquito-borne parasites species or subspecies, further divided according to drug resistance. The foregoing is for example purposes only. Other means for classifying other types of mosquito-borne parasites are also contemplated and would follow the general structure described above.

In certain example embodiments, the devices, systems and methods disclosed herein may be used to screen for mosquito-borne parasite genes of interest, for example drug resistance genes. Guide RNAs may be designed to distinguish between known genes of interest. Samples, including clinical samples, may then be screened using the embodiments disclosed herein for detection of one or more such genes. The ability to screen for drug resistance at POC would have tremendous benefit in selecting an appropriate treatment regime. In certain example embodiments, the drug resistance genes are genes encoding proteins such as transporter proteins, such as protein from drug/metabolite transporter family, the ATP-binding cassette (ABC) protein involved in substrate translocation, such as the ABC transporter C subfamily or the $Na^+/H^+$ exchanger; proteins involved in the folate pathway, such as the dihydropteroate synthase, the dihydrofolate reductase activity or the dihydrofolate reductase-thymidylate synthase; and proteins involved in the translocation of protons across the inner mitochondrial membrane and notably the cytochrome b complex. Additional targets may also include the gene(s) coding for the heme polymerase. In certain example embodiments, the drug resistance genes are selected from the *P. falciparum* chloroquine resistance transporter gene (pfcrt), the *P. falciparum* multidrug resistance transporter 1 (pfmdr1), the *P. falciparum* multidrug resistance-associated protein gene (Pfmrp), the *P. falciparum* Na+/H+ exchanger gene (pfnhe), the *P. falciparum* Ca2+ transporting ATPase 6 (pfatp6), the *P. falciparum* dihydropteroate synthase (pfdhps), dihydrofolate reductase activity (pfdhpr) and dihydrofolate reductase-thymidylate synthase (pfdhfr) genes, the cytochrome b gene, GTP cyclohydrolase and the Kelch13 (K13) gene as well as their functional heterologous genes in other *Plasmodium* species. Other identified drug-resistance markers are known in the art, for example as described in "*Susceptibility of Plasmodium falciparum to antimalarial drugs* (1996-2004)"; WHO; Artemisinin and artemisinin-based combination therapy resistance (April 2016 WHO/HTM/GMP/2016.5); "*Drug-resistant malaria: molecular mechanisms and implications for public health*" FEBS Lett. 2011 Jun. 6; 585(11):1551-62. doi:10.1016/j.febslet.2011.04.042. Epub 2011 Apr. 23. Review. PubMed PMID: 21530510; the contents of which are herewith incorporated by reference.

In some embodiments, a CRISPR system, detection system or methods of use thereof as described herein may be used to determine the evolution of a mosquito-borne parasite outbreak. The method may comprise detecting one or more target sequences from a plurality of samples from one or more subjects, wherein the target sequence is a sequence from a mosquito-borne parasite spreading or causing the outbreaks. Such a method may further comprise determining a pattern of mosquito-borne parasite transmission, or a mechanism involved in a disease outbreak caused by a mosquito-borne parasite. The samples may be derived from one or more humans, and/or be derived from one or more mosquitoes.

The pattern of pathogen transmission may comprise continued new transmissions from the natural reservoir of the mosquito-borne parasite or other transmissions (e.g. across mosquitoes) following a single transmission from the natural reservoir or a mixture of both. In one embodiment, the target sequence is preferably a sequence within the mosquito-borne parasite genome or fragments thereof. In one embodiment, the pattern of the mosquito-borne parasite transmission is the early pattern of the mosquito-borne parasite transmission, i.e. at the beginning of the mosquito-borne parasite outbreak. Determining the pattern of the mosquito-borne parasite transmission at the beginning of the outbreak increases likelihood of stopping the outbreak at the earliest possible time thereby reducing the possibility of local and international dissemination.

Determining the pattern of the mosquito-borne parasite transmission may comprise detecting a mosquito-borne parasite sequence according to the methods described herein. Determining the pattern of the pathogen transmission may further comprise detecting shared intra-host variations of the mosquito-borne parasite sequence between the subjects and determining whether the shared intra-host variations show temporal patterns. Patterns in observed intrahost and interhost variation provide important insight about transmission and epidemiology (Gire, et al., 2014).

In addition to other sample types disclosed herein, the sample may be derived from one or more mosquitoes, for example the sample may comprise mosquito saliva.

Biomarker Detection

In certain example embodiments, the systems, devices, and methods disclosed herein may be used for biomarker detection. For example, the systems, devices and method disclosed herein may be used for SNP detection and/or genotyping. The systems, devices and methods disclosed herein may be also used for the detection of any disease state or disorder characterized by aberrant gene expression. Aberrant gene expression includes aberration in the gene expressed, location of expression and level of expression. Multiple transcripts or protein markers related to cardiovascular, immune disorders, and cancer among other diseases may be detected. In certain example embodiments, the embodiments disclosed herein may be used for cell free DNA detection of diseases that involve lysis, such as liver fibrosis and restrictive/obstructive lung disease. In certain example embodiments, the embodiments could be utilized for faster and more portable detection for pre-natal testing of cell-free DNA. The embodiments disclosed herein may be used for screening panels of different SNPs associated with, among others, cardiovascular health, lipid/metabolic signatures, ethnicity identification, paternity matching, human ID (e.g. matching suspect to a criminal database of SNP signatures). The embodiments disclosed herein may also be used for cell free DNA detection of mutations related to and released from cancer tumors. The embodiments disclosed herein may also be used for detection of meat quality, for example, by providing rapid detection of different animal sources in a given meat product. Embodiments disclosed herein may also be used for the detection of GMOs or gene editing related to DNA. As described herein elsewhere, closely related genotypes/alleles or biomarkers (e.g. having only a single nucleotide difference in a given target sequence) may be distinguished by introduction of a synthetic mismatch in the gRNA.

In an aspect, the invention relates to a method for detecting target nucleic acids in samples, comprising:

distributing a sample or set of samples into one or more individual discrete volumes, the individual discrete volumes comprising a CRISPR system according to the invention as described herein;

incubating the sample or set of samples under conditions sufficient to allow binding of the one or more guide RNAs to one or more target molecules;

activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample.

Biomarker Sample Types

The sensitivity of the assays described herein are well suited for detection of target nucleic acids in a wide variety of biological sample types, including sample types in which the target nucleic acid is dilute or for which sample material is limited. Biomarker screening may be carried out on a number of sample types including, but not limited to, saliva, urine, blood, feces, sputum, and cerebrospinal fluid. The embodiments disclosed herein may also be used to detect up- and/or down-regulation of genes. For example, a s sample may be serially diluted such that only over-expressed genes remain above the detection limit threshold of the assay.

In certain embodiments, the present invention provides steps of obtaining a sample of biological fluid (e.g., urine, blood plasma or serum, sputum, cerebral spinal fluid), and extracting the DNA. The mutant nucleotide sequence to be detected, may be a fraction of a larger molecule or can be present initially as a discrete molecule.

In certain embodiments, DNA is isolated from plasma/serum of a cancer patient. For comparison, DNA samples isolated from neoplastic tissue and a second sample may be isolated from non-neoplastic tissue from the same patient (control), for example, lymphocytes. The non-neoplastic tissue can be of the same type as the neoplastic tissue or from a different organ source. In certain embodiments, blood samples are collected and plasma immediately separated from the blood cells by centrifugation. Serum may be filtered and stored frozen until DNA extraction.

In certain example embodiments, target nucleic acids are detected directly from a crude or unprocessed sample, such as blood, serum, saliva, cebrospinal fluid, sputum, or urine. In certain example embodiments, the target nucleic acid is cell free DNA.

Circulating Tumor Cells

In one embodiment, circulating cells (e.g., circulating tumor cells (CTC)) can be assayed with the present invention. Isolation of circulating tumor cells (CTC) for use in any of the methods described herein may be performed. Exemplary technologies that achieve specific and sensitive detection and capture of circulating cells that may be used in the present invention have been described (Mostert B, et al., Circulating tumor cells (CTCs): detection methods and their clinical relevance in breast cancer. Cancer Treat Rev. 2009; 35:463-474; and Talasaz A H, et al., Isolating highly enriched populations of circulating epithelial cells and other rare cells from blood using a magnetic sweeper device. Proc Natl Acad Sci USA. 2009; 106:3970-3975). As few as one CTC may be found in the background of 105-106 peripheral blood mononuclear cells (Ross A A, et al., Detection and viability of tumor cells in peripheral blood stem cell collections from breast cancer patients using immunocytochemical and clonogenic assay techniques. Blood. 1993, 82:2605-2610). The CellSearch® platform uses immunomagnetic beads coated with antibodies to Epithelial Cell Adhesion Molecule (EpCAM) to enrich for EPCAM-expressing epithelial cells, followed by immunostaining to confirm the presence of cytokeratin staining and absence of the leukocyte marker CD45 to confirm that captured cells are epithelial tumor cells (Momburg F, et al., Immunohistochemical study of the expression of a Mr 34,000 human epithelium-specific surface glycoprotein in normal and malignant tissues. Cancer Res. 1987; 47:2883-2891; and Allard W J, et al., Tumor cells circulate in the peripheral blood of all major carcinomas but not in healthy subjects or patients with nonmalignant diseases. Clin Cancer Res. 2004; 10:6897-6904). The number of cells captured have been prospectively demonstrated to have prognostic significance for breast, colorectal and prostate cancer patients with advanced disease (Cohen S J, et al., J Clin Oncol. 2008; 26:3213-3221; Cristofanilli M, et al. N Engl J Med. 2004; 351:781-791; Cristofanilli M, et al., J Clin Oncol. 2005; 23: 1420-1430; and de Bono J S, et al. Clin Cancer Res. 2008; 14:6302-6309).

The present invention also provides for isolating CTCs with CTC-Chip Technology. CTC-Chip is a microfluidic based CTC capture device where blood flows through a chamber containing thousands of microposts coated with anti-EpCAM antibodies to which the CTCs bind (Nagrath S, et al. Isolation of rare circulating tumour cells in cancer patients by microchip technology. Nature. 2007; 450: 1235-1239). CTC-Chip provides a significant increase in CTC counts and purity in comparison to the CellSearch® system (Maheswaran S, et al. Detection of mutations in EGFR in circulating lung-cancer cells, N Engl J Med. 2008; 359:366-377), both platforms may be used for downstream molecular analysis.

Cell-Free Chromatin

In certain embodiments, cell free chromatin fragments are isolated and analyzed according to the present invention. Nucleosomes can be detected in the serum of healthy individuals (Stroun et al., Annals of the New York Academy of Sciences 906: 161-168 (2000)) as well as individuals afflicted with a disease state. Moreover, the serum concentration of nucleosomes is considerably higher in patients suffering from benign and malignant diseases, such as cancer and autoimmune disease (Holdenrieder et al (2001) Int J Cancer 95, 1 14-120, Trejo-Becerril et al (2003) Int J Cancer 104, 663-668; Kuroi et al 1999 Breast Cancer 6, 361-364; Kuroi et al (2001) Int j Oncology 19, 143-148; Amoura et al (1997) Arth Rheum 40, 2217-2225; Williams et al (2001) J Rheumatol 28, 81-94). Not being bound by a theory, the high concentration of nucleosomes in tumor bearing patients derives from apoptosis, which occurs spontaneously in proliferating tumors. Nucleosomes circulating in the blood contain uniquely modified histones. For example, U.S. Patent Publication No. 2005/0069931 (Mar. 31, 2005) relates to the use of antibodies directed against specific histone N-terminus modifications as diagnostic indicators of disease, employing such histone-specific antibodies to isolate nucleosomes from a blood or serum sample of a patient to facilitate purification and analysis of the accompanying DNA for diagnostic/screening purposes. Accordingly, the present invention may use chromatin bound DNA to detect and monitor, for example, tumor mutations. The identification of the DNA associated with modified histones can serve as diagnostic markers of disease and congenital defects.

Thus, in another embodiment, isolated chromatin fragments are derived from circulating chromatin, preferably circulating mono and oligonucleosomes. Isolated chromatin fragments may be derived from a biological sample. The biological sample may be from a subject or a patient in need thereof. The biological sample may be sera, plasma, lymph, blood, blood fractions, urine, synovial fluid, spinal fluid, saliva, circulating tumor cells or mucous.

Cell-Free DNA (cfDNA)

In certain embodiments, the present invention may be used to detect cell free DNA (cfDNA). Cell free DNA in plasma or serum may be used as a non-invasive diagnostic tool. For example, cell free fetal DNA has been studied and optimized for testing on-compatible RhD factors, sex determination for X-linked genetic disorders, testing for single gene disorders, indentificaiton of preeclampsia. For example, sequencing the fetal cell fraction of cfDNA in maternal plasma is a reliable approach for detecting copy number changes associated with fetal chromosome aneuploidy. For another example, cfDNA isolated from cancer patients has been used to detect mutations in key genes relevant for treatment decisions.

In certain example embodiments, the present disclosure provides detecting cfDNA directly from a patient sample. In certain other example embodiment, the present disclosure provides enriching cfDNA using the enrichment embodiments disclosed above and prior to detecting the target cfDNA.

Exosomes

In one embodiment, exosomes can be assayed with the present invention. Exosomes are small extracellular vesicles that have been shown to contain RNA. Isolation of exosomes by ultracentrifugation, filtration, chemical precipitation, size exclusion chromatography, and microfluidics are known in the art. In one embodiment exosomes are purified using an exosome biomarker. Isolation and purification of exosomes from biological samples may be performed by any known methods (see e.g., WO2016172598A1).

SNP Detection and Genotyping

In certain embodiments, the present invention may be used to detect the presence of single nucleotide polymorphisms (SNP) in a biological sample. The SNPs may be related to maternity testing (e.g., sex determination, fetal defects). They may be related to a criminal investigation. In one embodiment, a suspect in a criminal investigation may be identified by the present invention. Not being bound by a theory nucleic acid based forensic evidence may require the most sensitive assay available to detect a suspect or victim's genetic material because the samples tested may be limiting.

In other embodiments, SNPs associated with a disease are encompassed by the present invention. SNPs associated with diseases are well known in the art and one skilled in the art can apply the methods of the present invention to design suitable guide RNAs (see e.g., www.ncbi.nlm.nih.gov/clinvar?term=human%5Borgn%5D).

In an aspect, the invention relates to a method for genotyping, such as SNP genotyping, comprising:

distributing a sample or set of samples into one or more individual discrete volumes, the individual discrete volumes comprising a CRISPR system according to the invention as described herein;

incubating the sample or set of samples under conditions sufficient to allow binding of the one or more guide RNAs to one or more target molecules;

activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules characteristic for a particular genotype in the sample.

In certain embodiments, the detectable signal is compared to (e.g. by comparison of signal intensity) one or more standard signal, preferably a synthetic standard signal, such as for instance illustrated in an embodiment in FIG. 60. In certain embodiments, the standard is or corresponds to a particular genotype. In certain embodiments, the standard comprises a particular SNP or other (single) nucleotide variation. In certain embodiments, the standard is a (PCR-amplified) genotype standard. In certain embodiments, the standard is or comprises DNA. In certain embodiments, the standard is or comprises RNA. In certain embodiments, the standard is or comprised RNA which is transcribed from DNA. In certain embodiments, the standard is or comprises DNA which is reverse transcribed from RNA. In certain embodiments, the detectable signal is compared to one or more standard, each of which corresponds to a known genotype, such as a SNP or other (single) nucleotide variation. In certain embodiments, the detectable signal is compared to one or more standard signal and the comparison comprises statistical analysis, such as by parametric or non-parametric statistical analysis, such as by one- or two-way ANOVA, etc. In certain embodiments, the detectable signal is compared to one or more standard signal and when the detectable signal does not (statistically) significantly deviate from the standard, the genotype is determined as the genotype corresponding to said standard.

In other embodiments, the present invention allows rapid genotyping for emergency pharmacogenomics. In one embodiment, a single point of care assay may be used to genotype a patient brought in to the emergency room. The patient may be suspected of having a blood clot and an emergency physician needs to decide a dosage of blood thinner to administer. In exemplary embodiments, the present invention may provide guidance for administration of blood thinners during myocardial infarction or stroke treatment based on genotyping of markers such as VKORC1, CYP2C9, and CYP2C19. In one embodiment, the blood thinner is the anticoagulant warfarin (Holford, N.H. (December 1986). "Clinical Pharmacokinetics and Pharmacodynamics of Warfarin Understanding the Dose-Effect Relationship". Clinical Pharmacokinetics. Springer International Publishing. 11 (6): 483-504). Genes associated with blood clotting are known in the art (see e.g., US20060166239A1; Litin S C, Gastineau D A (1995) "Current concepts in anticoagulant therapy". Mayo Clin. Proc. 70 (3): 266-72; and Rusdiana et al., Responsiveness to low-dose warfarin associated with genetic variants of VKORC1, CYP2C9, CYP2C19, and CYP4F2 in an Indonesian population. Eur J Clin Pharmacol. 2013 March; 69(3):395-405). Specifically, in the VKORC1 1639 (or 3673) single-nucleotide polymorphism, the common ("wild-type") G allele is replaced by the A allele. People with an A allele (or the "A haplotype") produce less VKORC1 than do those with the G allele (or the "non-A haplotype"). The prevalence of these variants also varies by race, with 37% of Caucasians and 14% of Africans carrying the A allele. The end result is a decreased number of clotting factors and therefore, a decreased ability to clot.

In certain example embodiments, the availability of genetic material for detecting a SNP in a patient allows for detecting SNPs without amplification of a DNA or RNA sample. In the case of genotyping, the biological sample tested is easily obtained. In certain example embodiments, the incubation time of the present invention may be shortened. The assay may be performed in a period of time required for an enzymatic reaction to occur. One skilled in the art can perform biochemical reactions in 5 minutes (e.g., 5 minute ligation). The present invention may use an automated DNA extraction device to obtain DNA from blood. The DNA can then be added to a reaction that generates a target molecule for the effector protein. Immediately upon generating the target molecule the masking agent can be cut and a signal detected. In exemplary embodiments, the present invention allows a POC rapid diagnostic for determining a genotype before administering a drug (e.g., blood thinner). In the case where an amplification step is used, all of the reactions occur in the same reaction in a one step process. In preferred embodiments, the POC assay may be performed in less than an hour, preferably 10 minutes, 20 minutes, 30 minutes, 40 minutes, or 50 minutes.

In certain embodiments, the systems, devices, and methods disclosed herein may be used for detecting the presence or expression level of long non-coding RNAs (lncRNAs). Expression of certain lncRNAs are associated with disease state and/or drug resistance. In particular, certain lncRNAs (e.g., TCONS_00011252, NR 034078, TCONS_00010506, TCONS_00026344, TCONS_00015940, TCONS_00028298, TCONS_00026380, TCONS_0009861, TCONS_00026521, TCONS_00016127, NR 125939, NR 033834, TCONS_00021026, TCONS_00006579, NR 109890, and NR 026873) are associated with resistance to cancer treatment, such as resistance to one or more BRAF inhibitors (e.g., Vemurafenib, Dabrafenib, Sorafenib, GDC-0879, PLX-4720, and LGX818) for treating melanoma (e.g., nodular melanoma, lentigo maligna, lentigo maligna melanoma, acral lentiginous melanoma, superficial spreading melanoma, mucosal melanoma, polypoid melanoma, desmoplastic melanoma, amelanotic melanoma, and soft-tissue melanoma). The detection of lncRNAs using the various embodiments described herein can facilitate disease diagnosis and/or selection of treatment options.

In one embodiment, the present invention can guide DNA- or RNA-targeted therapies (e.g., CRISPR, TALE, Zinc finger proteins, RNAi), particularly in settings where rapid administration of therapy is important to treatment outcomes.

LOH Detection

Cancer cells undergo a loss of genetic material (DNA) when compared to normal cells. This deletion of genetic material which almost all, if not all, cancers undergo is referred to as "loss of heterozygosity" (LOH). Loss of heterozygosity (LOH) is a gross chromosomal event that results in loss of the entire gene and the surrounding chromosomal region. The loss of heterozygosity is a common occurrence in cancer, where it can indicate the absence of a functional tumor suppressor gene in the lost region. However, a loss may be silent because there still is one functional gene left on the other chromosome of the chromosome pair. The remaining copy of the tumor suppressor gene can be inactivated by a point mutation, leading to loss of a tumor suppressor gene. The loss of genetic material from cancer cells can result in the selective loss of one of two or more alleles of a gene vital for cell viability or cell growth at a particular locus on the chromosome.

An "LOH marker" is DNA from a microsatellite locus, a deletion, alteration, or amplification in which, when compared to normal cells, is associated with cancer or other diseases. An LOH marker often is associated with loss of a tumor suppressor gene or another, usually tumor related, gene.

The term "microsatellites" refers to short repetitive sequences of DNA that are widely distributed in the human genome. A microsatellite is a tract of tandemly repeated (i.e. adjacent) DNA motifs that range in length from two to five nucleotides, and are typically repeated 5-50 times. For example, the sequence TATATATATA (SEQ ID NO:431) is a dinucleotide microsatellite, and GTCGTCGTCGTCGTC (SEQ ID NO:432) is a trinucleotide microsatellite (with A being Adenine, G Guanine, C Cytosine, and T Thymine). Somatic alterations in the repeat length of such microsatellites have been shown to represent a characteristic feature of tumors. Guide RNAs may be designed to detect such microsatellites. Furthermore, the present invention may be used to detect alterations in repeat length, as well as amplifications and deletions based upon quantitation of the detectable signal. Certain microsatellites are located in regulatory flanking or intronic regions of genes, or directly in codons of genes. Microsatellite mutations in such cases can lead to phenotypic changes and diseases, notably in triplet expansion diseases such as fragile X syndrome and Huntington's disease.

Frequent loss of heterozygosity (LOH) on specific chromosomal regions has been reported in many kinds of malignancies. Allelic losses on specific chromosomal regions are the most common genetic alterations observed in a variety of malignancies, thus microsatellite analysis has been applied to detect DNA of cancer cells in specimens from body fluids, such as sputum for lung cancer and urine for bladder cancer. (Rouleau, et al. Nature 363, 515-521 (1993); and Latif, et al. Science 260, 1317-1320 (1993)). Moreover, it has been established that markedly increased concentrations of soluble DNA are present in plasma of individuals with cancer and some other diseases, indicating that cell free serum or plasma can be used for detecting cancer DNA with microsatellite abnormalities. (Kamp, et al. Science 264, 436-440 (1994); and Steck, et al. Nat Genet. 15(4), 356-362 (1997)). Two groups have reported microsatellite alterations in plasma or serum of a limited number of patients with small cell lung cancer or head and neck cancer. (Hahn, et al. Science 271, 350-353 (1996); and Miozzo, et al. Cancer Res. 56, 2285-2288 (1996)). Detection of loss of heterozygosity in tumors and serum of melanoma patients has also been previously shown (see, e.g., United States patent number U.S. Pat. No. 6,465,177B1).

Thus, it is advantageous to detect of LOH markers in a subject suffering from or at risk of cancer. The present invention may be used to detect LOH in tumor cells. In one embodiment, circulating tumor cells may be used as a biological sample. In preferred embodiments, cell free DNA obtained from serum or plasma is used to noninvasively detect and/or monitor LOH. In other embodiments, the biological sample may be any sample described herein (e.g., a urine sample for bladder cancer). Not being bound by a theory, the present invention may be used to detect LOH markers with improved sensitivity as compared to any prior method, thus providing early detection of mutational events. In one embodiment, LOH is detected in biological fluids, wherein the presence of LOH is associated with the occurrence of cancer. The method and systems described herein represents a significant advance over prior techniques, such as PCR or tissue biopsy by providing a non-invasive, rapid, and accurate method for detecting LOH of specific alleles associated with cancer. Thus, the present invention provides a methods and systems which can be used to screen high-risk populations and to monitor high risk patients undergoing chemoprevention, chemotherapy, immunotherapy or other treatments.

Because the method of the present invention requires only DNA extraction from bodily fluid such as blood, it can be performed at any time and repeatedly on a single patient. Blood can be taken and monitored for LOH before or after surgery; before, during, and after treatment, such as chemotherapy, radiation therapy, gene therapy or immunotherapy; or during follow-up examination after treatment for disease progression, stability, or recurrence. Not being bound by a theory, the method of the present invention also may be used to detect subclinical disease presence or recurrence with an LOH marker specific for that patient since LOH markers are specific to an individual patient's tumor. The method also can detect if multiple metastases may be present using tumor specific LOH markers.

Detection of Epigenetic Modifications

Histone variants, DNA modifications, and histone modifications indicative of cancer or cancer progression may be used in the present invention. For example, U.S. patent publication 20140206014 describes that cancer samples had elevated nucleosome H2AZ, macroH2A1.1, 5-methylcytosine, P-H2AX(Ser139) levels as compared to healthy subjects. The presence of cancer cells in an individual may generate a higher level of cell free nucleosomes in the blood as a result of the increased apoptosis of the cancer cells. In one embodiment, an antibody directed against marks associated with apoptosis, such as H2B Ser 14(P), may be used to identify single nucleosomes that have been released from apoptotic neoplastic cells. Thus, DNA arising from tumor cells may be advantageously analyzed according to the present invention with high sensitivity and accuracy.

Pre-Natal Screening

In certain embodiments, the method and systems of the present invention may be used in prenatal screening. In certain embodiments, cell-free DNA is used in a method of prenatal screening. In certain embodiments, DNA associated with single nucleosomes or oligonucleosomes may be detected with the present invention. In preferred embodiments, detection of DNA associated with single nucleosomes or oligonucleosomes is used for prenatal screening. In certain embodiments, cell-free chromatin fragments are used in a method of prenatal screening.

Prenatal diagnosis or prenatal screening refers to testing for diseases or conditions in a fetus or embryo before it is born. The aim is to detect birth defects such as neural tube defects, Down syndrome, chromosome abnormalities, genetic disorders and other conditions, such as spina bifida, cleft palate, Tay Sachs disease, sickle cell anemia, thalassemia, cystic fibrosis, Muscular dystrophy, and fragile X syndrome. Screening can also be used for prenatal sex discernment. Common testing procedures include amniocentesis, ultrasonography including nuchal translucency ultrasound, serum marker testing, or genetic screening. In some cases, the tests are administered to determine if the fetus will be aborted, though physicians and patients also find it useful to diagnose high-risk pregnancies early so that delivery can be scheduled in a tertian,' care hospital where the baby can receive appropriate care.

It has been realized that there are fetal cells which are present in the mother's blood, and that these cells present a potential source of fetal chromosomes for prenatal DNA-based diagnostics. Additionally, fetal DNA ranges from about 2-10% of the total DNA in maternal blood. Currently available prenatal genetic tests usually involve invasive procedures. For example, chorionic villus sampling (CVS) performed on a pregnant woman around 10-12 weeks into the pregnancy and amniocentesis performed at around 14-16 weeks all contain invasive procedures to obtain the sample for testing chromosomal abnormalities in a fetus. Fetal cells obtained via these sampling procedures are usually tested for chromosomal abnormalities using cytogenetic or fluorescent in situ hybridization (FISH) analyses. Cell-free fetal DNA has been shown to exist in plasma and serum of pregnant women as early as the sixth week of gestation, with concentrations rising during pregnancy and peaking prior to parturition. Because these cells appear very early in the pregnancy, they could form the basis of an accurate, noninvasive, first trimester test. Not being bound by a theory, the present invention provides unprecedented sensitivity in detecting low amounts of fetal DNA. Not being bound by a theory, abundant amounts of maternal DNA is generally concomitantly recovered along with the fetal DNA of interest, thus decreasing sensitivity in fetal DNA quantification and mutation detection. The present invention overcomes such problems by the unexpectedly high sensitivity of the assay.

The H3 class of histones consists of four different protein types: the main types, H3.1 and H3.2; the replacement type, H3.3; and the testis specific variant, H3t. Although H3.1 and H3.2 are closely related, only differing at Ser96, H3.1 differs from H3.3 in at least 5 amino acid positions. Further, H3.1 is highly enriched in fetal liver, in comparison to its presence in adult tissues including liver, kidney and heart. In adult human tissue, the H3.3 variant is more abundant than the H3.1 variant, whereas the converse is true for fetal liver. The present invention may use these differences to detect fetal nucleosomes and fetal nucleic acid in a maternal biological sample that comprises both fetal and maternal cells and/or fetal nucleic acid.

In one embodiment, fetal nucleosomes may be obtained from blood. In other embodiments, fetal nucleosomes are obtained from a cervical mucus sample. In certain embodiments, a cervical mucus sample is obtained by swabbing or lavage from a pregnant woman early in the second trimester or late in the first trimester of pregnancy. The sample may be placed in an incubator to release DNA trapped in mucus. The incubator may be set at 37° C. The sample may be rocked for approximately 15 to 30 minutes. Mucus may be further dissolved with a mucinase for the purpose of releasing DNA. The sample may also be subjected to conditions, such as chemical treatment and the like, as well known in the art, to induce apoptosis to release fetal nucleosomes. Thus, a cervical mucus sample may be treated with an agent that induces apoptosis, whereby fetal nucleosomes are released. Regarding enrichment of circulating fetal DNA, reference is made to U.S. patent publication Nos. 20070243549 and 20100240054. The present invention is especially advantageous when applying the methods and systems to prenatal screening where only a small fraction of nucleosomes or DNA may be fetal in origin.

Prenatal screening according to the present invention may be for a disease including, but not limited to Trisomy 13, Trisomy 16, Trisomy 18, Klinefelter syndrome (47, XXY), (47, XYY) and (47, XXX), Turner syndrome, Down syndrome (Trisomy 21), Cystic Fibrosis, Huntington's Disease, Beta Thalassaemia, Myotonic Dystrophy, Sickle Cell Anemia, Porphyria, Fragile-X-Syndrome, Robertsonian translocation, Angelman syndrome, DiGeorge syndrome and Wolf-Hirschhorn Syndrome.

Several further aspects of the invention relate to diagnosing, prognosing and/or treating defects associated with a wide range of genetic diseases which are further described on the website of the National Institutes of Health under the topic subsection Genetic Disorders (website at health.nih.gov/topic/Genetic Disorders).

Cancer and Cancer Drug Resistance Detection

In certain embodiments, the present invention may be used to detect genes and mutations associated with cancer. In certain embodiments, mutations associated with resistance are detected. The amplification of resistant tumor cells or appearance of resistant mutations in clonal populations of tumor cells may arise during treatment (see, e.g., Burger J A, et al., Clonal evolution in patients with chronic lymphocytic leukaemia developing resistance to BTK inhibition. Nat Commun. 2016 May 20; 7:11589; Landau D A, et al., Mutations driving CLL and their evolution in progression and relapse. Nature. 2015 Oct. 22; 526(7574):525-30; Landau D A, et al., Clonal evolution in hematological malignancies and therapeutic implications. Leukemia. 2014 January; 28(1):34-43; and Landau D A, et al., Evolution and impact of subclonal mutations in chronic lymphocytic leukemia. Cell. 2013 Feb. 14; 152(4):714-26). Accordingly, detecting such mutations requires highly sensitive assays and monitoring requires repeated biopsy. Repeated biopsies are inconvenient, invasive and costly. Resistant mutations can be difficult to detect in a blood sample or other noninvasively collected biological sample (e.g., blood, saliva, urine) using the prior methods known in the art. Resistant mutations may refer to mutations associated with resistance to a chemotherapy, targeted therapy, or immunotherapy.

In certain embodiments, mutations occur in individual cancers that may be used to detect cancer progression. In one embodiment, mutations related to T cell cytolytic activity against tumors have been characterized and may be detected by the present invention (see e.g., Rooney et al., Molecular and genetic properties of tumors associated with local immune cytolytic activity, Cell. 2015 Jan. 15; 160(1-2): 48-61). Personalized therapies may be developed for a patient based on detection of these mutations (see e.g., WO2016100975A1). In certain embodiments, cancer specific mutations associated with cytolytic activity may be a mutation in a gene selected from the group consisting of CASP8, B2M, PIK3CA, SMC1A, ARID5B, TET2, ALPK2, COL5A1, TP53, DNER, NCOR1, MORC4, CIC, IRF6, MYOCD, ANKLE1, CNKSR1, NF1, SOS1, ARID2, CUL4B, DDX3X, FUBP1, TCP11L2, HLA-A, B or C, CSNK2A1, MET, ASXL1, PD-L1, PD-L2, IDO1, IDO2, ALOX12B and ALOX15B, or copy number gain, excluding whole-chromosome events, impacting any of the following chromosomal bands: 6q16.1-q21, 6q22.31z-q24.1, 6q25.1-q26, 7p11.2-q11.1, 8p23.1, 8p11.23-p11.21 (containing IDO1, IDO2), 9p24.2-p23 (containing PDL1, PDL2), 10p15.3, 10p15.1-p13, 11p14.1, 12p13.32-p13.2, 17p13.1 (containing ALOX12B, ALOX15B), and 22q11.1-q11.21.

In certain embodiments, the present invention is used to detect a cancer mutation (e.g., resistance mutation) during the course of a treatment and after treatment is completed. The sensitivity of the present invention may allow for noninvasive detection of clonal mutations arising during treatment and can be used to detect a recurrence in the disease.

In certain example embodiments, detection of microRNAs (miRNA) and/or miRNA signatures of differentially expressed miRNA, may used to detect or monitor progression of a cancer and/or detect drug reisastance to a cancer therapy. As an example, Nadal et al. (Nature Scientific Reports, (2015) doi:10.1038/srep12464) describe mRNA signatures that may be used to detect non-small cell lung cancer (NSCLC).

In certain example embodiments, the presence of resistance mutations in clonal subpopulations of cells may be used in determining a treatment regimen. In other embodiments, personalized therapies for treating a patient may be administered based on common tumor mutations. In certain embodiments, common mutations arise in response to treatment and lead to drug resistance. In certain embodiments, the present invention may be used in monitoring patients for cells acquiring a mutation or amplification of cells harboring such drug resistant mutations.

Treatment with various chemotherapeutic agents, particularly with targeted therapies such as tyrosine kinase inhibitors, frequently leads to new mutations in the target molecules that resist the activity of the therapeutic. Multiple strategies to overcome this resistance are being evaluated, including development of second generation therapies that are not affected by these mutations and treatment with multiple agents including those that act downstream of the resistance mutation. In an exemplary embodiment, a common mutation to ibrutinib, a molecule targeting Bruton's Tyrosine Kinase (BTK) and used for CLL and certain lymphomas, is a Cysteine to Serine change at position 481 (BTK/C481S). Erlotinib, which targets the tyrosine kinase domain of the Epidermal Growth Factor Receptor (EGFR), is commonly used in the treatment of lung cancer and resistant tumors invariably develop following therapy. A common mutation found in resistant clones is a threonine to methionine mutation at position 790.

Non-silent mutations shared between populations of cancer patients and common resistant mutations that may be detected with the present invention are known in the art (see e.g., WO/2016/187508). In certain embodiments, drug resistance mutations may be induced by treatment with ibrutinib, erlotinib, imatinib, gefitinib, crizotinib, trastuzumab, vemurafenib, RAF/MEK, check point blockade therapy, or anti-estrogen therapy. In certain embodiments, the cancer specific mutations are present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Abl, c-kit, PIK3CA, HER2, EML4-ALK, KRAS, ALK, ROS1, AKT1, BRAF, MEK1, MEK2, NRAS, RAC1, and ESR1.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Recently, gene expression in tumors and their microenvironments have been characterized at the single cell level (see e.g., Tirosh, et al. Dissecting the multicellular ecosystem of metastatic melanoma by single cell RNA-seq. Science 352, 189-196, doi:10.1126/science.aad0501 (2016)); Tirosh et al., Single-cell RNA-seq supports a developmental hierarchy in human oligodendroglioma. Nature. 2016 Nov. 10; 539(7628):309-313. doi: 10.1038/nature20123. Epub 2016 Nov. 2; and International patent publication serial number WO 2017004153 A1). In certain embodiments, gene signatures may be detected using the present invention. In one embodiment complement genes are monitored or detected in a tumor microenvironment. In one embodiment MITF and AXL programs are monitored or detected. In one embodiment, a tumor specific stem cell or progenitor cell signature is detected. Such signatures indicate the state of an immune response and state of a tumor. In certain embodiments, the state of a tumor in terms of proliferation, resistance to treatment and abundance of immune cells may be detected.

Thus, in certain embodiments, the invention provides low-cost, rapid, multiplexed cancer detection panels for circulating DNA, such as tumor DNA, particularly for monitoring disease recurrence or the development of common resistance mutations.

Immunotherapy Applications

The embodiments disclosed herein can also be useful in further immunotherapy contexts. For instance, in some embodiments methods of diagnosing, prognosing and/or staging an immune response in a subject comprise detecting a first level of expression, activity and/or function of one or more biomarker and comparing the detected level to a control level wherein a difference in the detected level and the control level indicates that the presence of an immune response in the subject.

In certain embodiments, the present invention may be used to determine dysfunction or activation of tumor infiltrating lymphocytes (TIL). TILs may be isolated from a tumor using known methods. The TILs may be analyzed to determine whether they should be used in adoptive cell transfer therapies. Additionally, chimeric antigen receptor T cells (CAR T cells) may be analyzed for a signature of dysfunction or activation before administering them to a subject. Exemplary signatures for dysfunctional and activated T cell have been described (see e.g., Singer M, et al., A Distinct Gene Module for Dysfunction Uncoupled from Activation in Tumor-Infiltrating T Cells. Cell. 2016 Sep. 8; 166(6):1500-1511.e9. doi: 10.1016/j.cell.2016.08.052).

In some embodiments, C2c2 is used to evaluate that state of immune cells, such as T cells (e.g., CD8+ and/or CD4+ T cells). In particular, T cell activation and/or dysfunction can be determined, e.g., based on genes or gene signatures associated with one or more of the T cell states. In this way, c2c2 can be used to determine the presence of one or more subpopulations of T cells.

In some embodiments, C2c2 can be used in a diagnostic assay or may be used as a method of determining whether a patient is suitable for administering an immunotherapy or another type of therapy. For example, detection of gene or biomarker signatures may be performed via c2c2 to determine whether a patient is responding to a given treatment or, if the patient is not responding, if this may be due to T cell dysfunction. Such detection is informative regarding the types of therapy the patient is best suited to receive. For example, whether the patient should receive immunotherapy.

In some embodiments, the systems and assays disclosed herein may allow clinicians to identify whether a patient's response to a therapy (e.g., an adoptive cell transfer (ACT) therapy) is due to cell dysfunction, and if it is, levels of up-regulation and down-regulation across the biomarker signature will allow problems to be addressed. For example, if a patient receiving ACT is non-responsive, the cells administered as part of the ACT may be assayed by an assay disclosed herein to determine the relative level of expression of a biomarker signature known to be associated with cell activation and/or dysfunction states. If a particular inhibitory receptor or molecule is up-regulated in the ACT cells, the patient may be treated with an inhibitor of that receptor or molecule. If a particular stimulatory receptor or molecule is down-regulated in the ACT cells, the patient may be treated with an agonist of that receptor or molecule.

In certain example embodiments, the systems, methods, and devices described herein may be used to screen gene signatures that identify a particular cell type, cell phenotype, or cell state. Likewise, through the use of such methods as compressed sensing, the embodiments disclosed herein may be used to detect transcriptomes. Gene expression data are highly structured, such that the expression level of some genes is predictive of the expression level of others. Knowledge that gene expression data are highly structured allows for the assumption that the number of degrees of freedom in the system are small, which allows for assuming that the basis for computation of the relative gene abundances is sparse. It is possible to make several biologically motivated assumptions that allow Applicants to recover the nonlinear interaction terms while under-sampling without having any specific knowledge of which genes are likely to interact. In particular, if Applicants assume that genetic interactions are low rank, sparse, or a combination of these, then the true number of degrees of freedom is small relative to the complete combinatorial expansion, which enables Applicants to infer the full nonlinear landscape with a relatively small number of perturbations. Working around these assumptions, analytical theories of matrix completion and compressed sensing may be used to design under-sampled combinatorial perturbation experiments. In addition, a kernel-learning framework may be used to employ under-sampling by building predictive functions of combinatorial perturbations without directly learning any individual interaction coefficient Compresses sensing provides a way to identify the minimal number of target transcripts to be detected in order obtain a comprehensive gene-expression profile. Methods for compressed sensing are disclosed in PCT/US2016/059230 "Systems and Methods for Determining Relative Abundances of Biomolecules" filed Oct. 27, 2016, which is incorporated herein by reference. Having used methods like compressed sensing to identify a minimal transcript target set, a set of corresponding guide RNAs may then be designed to detect said transcripts. Accordingly, in certain example embodiments, a method for obtaining a gene-expression profile of cell comprises detecting, using the embodiments disclosed, herein a minimal transcript set that provides a gene-expression profile of a cell or population of cells.

Detecting Nucleic Acid Tagged Items

Alternatively, the embodiments described herein may be used to detect nucleic acid identifiers. Nucleic acid identifiers are non-coding nucleic acids that may be used to identify a particular article. Example nucleic acid identifiers, such as DNA watermarks, are described in Heider and Barnekow. "DNA watermarks: A proof of concept" BMC Molecular Biology 9:40 (2008). The nucleic acid identifiers may also be a nucleic acid barcode. A nucleic-acid based barcode is a short sequence of nucleotides (for example, DNA, RNA, or combinations thereof) that is used as an identifier for an associated molecule, such as a target molecule and/or target nucleic acid. A nucleic acid barcode can have a length of at least, for example, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, or 100 nucleotides, and can be in single- or double-stranded form. One or more nucleic acid barcodes can be attached, or "tagged," to a target molecule and/or target nucleic acid. This attachment can be direct (for example, covalent or non-covalent binding of the barcode to the target molecule) or indirect (for example, via an additional molecule, for example, a specific binding agent, such as an antibody (or other protein) or a barcode receiving adaptor (or other nucleic acid molecule). Target molecule and/or target nucleic acids can be labeled with multiple nucleic acid barcodes in combinatorial fashion, such as a nucleic acid barcode concatemer. Typically, a nucleic acid barcode is used to identify target molecules and/or target nucleic acids as being from a particular compartment (for example a discrete volume), having a particular physical property (for example, affinity, length, sequence, etc.), or having been subject to certain treatment conditions. Target molecule and/or target nucleic acid can be associated with multiple nucleic acid barcodes to provide information about all of these features (and more). Methods of generating nucleic acid-barcodes are disclosed, for example, in International Patent Application Publication No. WO/2014/047561.

Enzymes

The application further provides orthologs of C2c2 which demonstrate robust activity making them particularly suitable for different applications of RNA cleavage and detection. These applications include but are not limited to those described herein. More particularly, an ortholog which is demonstrated to have stronger activity than others tested is the C2c2 ortholog identified from the organism *Leptotrichia wadei* (LwC2c2). The application thus provides methods for modifying a target locus of interest, comprising delivering to said locus a non-naturally occurring or engineered composition comprising a C2c2 effector protein, more particularly a C2c2 effector protein with increased activity as described herein and one or more nucleic acid components, wherein at least the one or more nucleic acid components is engineered, the one or more nucleic acid components directs the complex to the target of interest and the effector protein forms a complex with the one or more nucleic acid components and the complex binds to the target locus of interest. In particular embodiments, the target locus of interest comprises RNA. The application further provides for the use of the Cc2 effector proteins with increased activity in RNA sequence specific interference, RNA sequence specific gene regulation, screening of RNA or RNA products or lincRNA or non-coding RNA, or nuclear RNA, or mRNA, mutagenesis, Fluorescence in situ hybridization, or breeding.

The invention is further described in the following examples, which do not limit the scope of the invention described in the claims.

EXAMPLES

Example 1—General Protocols

There are two ways to perform a C2c2 diagnostic test for DNA and RNA. This protocol may also be used with protein detection variants after delivery of the detection aptamers. The first is a two step reaction where amplification and C2c2 detection are done separately. The second is where everything is combined in one reaction and this is called a two-step reaction. It is important to keep in mind that amplification might not be necessary for higher concentration samples so it's good to have a separate C2c2 protocol that doesn't have amplification built in.

CRISPR Effector Only—No Amplification:

TABLE 7

| Component | Volume (μL) |
| --- | --- |
| Protein (44 nM final) | 2 |
| crRNA (12 nM final) | 1 |
| background target (100 ng total) | 1 |
| Target RNA (variable) | 1 |
| RNA sensor probe (125 nM) | 4 |
| MgCl$_2$ (6 mM final) | 2 |
| Reaction Buffer 10x | 2 |
| RNAse Inhibitors (murine from NEB) | 2 |
| H$_2$O | 5 |
| total | 20 |

Reaction buffer is: 40 mM Tris-HCl, 60 mM NaCl, pH 7.3

Perform this reaction for 20 min-3 hrs at 37° C. Read out with excitation: 485 nm/20 nm, emission: 528 nm/20 nm. A signal for single molecule sensitivity may be detected beginning at 20 min but of course sensitivity is higher for longer reaction times.

Two Step Reaction:

TABLE 8

| RPA amplification mix | |
| --- | --- |
| Component | Volume (μL) |
| Primer A (100 μM) | 0.48 |
| Primer B (100 μM) | 0.48 |
| RPA Buffer | 59 |
| MgAc | 5 |
| Target (variable concentration) | 5 |
| ATP (100 μM from NEB kit) | 2 |
| GTP (100 μM from NEB kit) | 2 |
| UTP (100 μM from NEB kit) | 2 |
| CTP (100 μM from NEB kit) | 2 |
| T7 Polymerase (from NEB kit) | 2 |
| H$_2$O | 25 |
| total | 104.96 |

Mix this reaction together and then re-suspend two to three tubes of freeze-dried enzyme mix). Add 5 μL of 280 mM MgAc to the mix to begin the reaction. Preform reaction for 10-20 min. Each reaction is 20 μL so this is enough for up to five reactions.

TABLE 9

C2c2 detection mix

| Component | Volume (μL) |
|---|---|
| Protein (44 nM final) | 2 |
| crRNA (12 nM final) | 1 |
| background target (100 ng total) | 1 |
| RPA reaction | 1 |
| RNA sensor probe (125 nM) | 4 |
| $MgCl_2$ (6 mM final) | 2 |
| Reaction Buffer 10x | 2 |
| RNAse Inhibitors (murine from NEB) | 2 |
| $H_2O$ | 5 |
| total | 20 |

Reaction buffer is: 40 mM Tris-HCl, 60 mM NaCl, pH 7.3

Perform this for 20 min-3 hours. Minimum detection time is about 20 min to see single molecule sensitivity. Performing the reaction for longer only boosts the sensitivity.

TABLE 10

One pot reaction:

| Component | Volume (μL) |
|---|---|
| Primer A (100 μM) | 0.48 |
| Primer B (100 μM) | 0.48 |
| RPA Buffer | 59 |
| MgAc | 5 |
| Lw2C2c2 (44 nM final) | 2 |
| crRNA (12 nM final) | 2 |
| Background RNA (from 250 ng/μL) | 2 |
| RNAse alert substr (after resuspending in 20 μL) | 5 |
| murine RNAse inhib from NEB | 10 |
| Target (variable concentration) | 5 |
| ATP (100 μM from NEB kit) | 2 |
| GTP (100 μM from NEB kit) | 2 |
| UTP (100 μM from NEB kit) | 2 |
| CTP (100 μM from NEB kit) | 2 |
| T7 Polymerase (from NEB kit) | 2 |
| $H_2O$ | 4 |
| total | 104.96 |

The NEB kit referenced is the HighScribe T7 High Yield Kit. To resuspend buffer, use a 1.5× concentration: resuspend three tubes of freeze dried substrate in 59 μL of buffer and use in the mix above. Each reaction is 20 μL so this is enough for 5 reactions worth. Single molecule sensitivity with this reaction has been observed in as early as 30-40 min.

Example 2—C2c2 from *Leptotrichia wadei* Mediates Highly Sensitive and Specific Detection of DNA and RNA Rapid, inexpensive, and sensitive nucleic acid detection may aid point-of-care pathogen detection, genotyping, and disease monitoring. The RNA-guided, RNA-targeting CRISPR effector Cas13a (previously known as C2c2) exhibits a "collateral effect" of promiscuous RNAse activity upon target recognition. We combine the collateral effect of Cas13a with isothermal amplification to establish a CRISPR-based diagnostic (CRISPR-Dx), providing rapid DNA or RNA detection with attomolar sensitivity and single-base mismatch specificity. We use this Cas13a-based molecular detection platform, termed SHERLOCK (Specific High Sensitivity Enzymatic Reporter UnLOCKing), to detect specific strains of Zika and Dengue virus, distinguish pathogenic bacteria, genotype human DNA, and identify cell-free tumor DNA mutations. Furthermore, SHERLOCK reaction reagents can be lyophilized for cold-chain independence and long-term storage, and readily reconstituted on paper for field applications.

Figure 17:
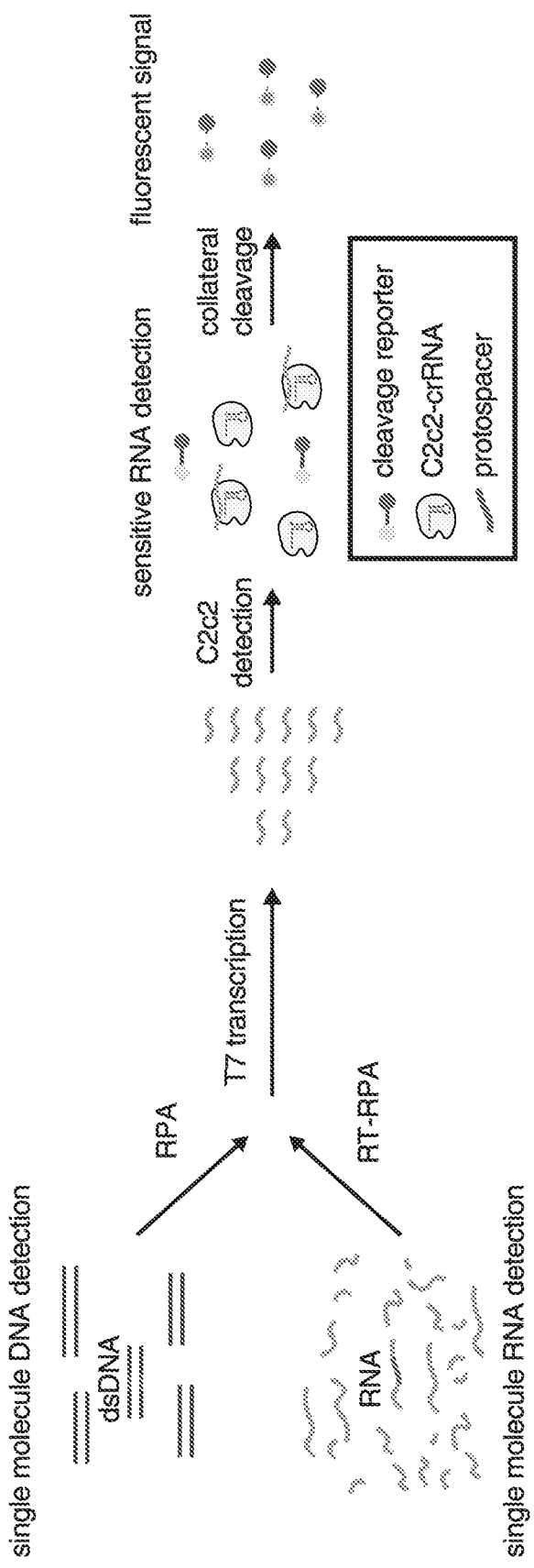
FIG. 17—schematic of SHERLOCK; provides a schematic showing detection of both DNA or RNA targets via incorporation of an RPA or an RT-RPA step accordingly. Upon recognition of target RNA, the collateral effect causes C2c2 to cut the cleavage reporter, generating fluorescence. Single-molecule amounts of RNA or DNA can be amplified to DNA via recombinase polymerase amplification (RPA) and transcribed to produce RNA, which is then detected by C2c2.

The ability to rapidly detect nucleic acids with high sensitivity and single-base specificity on a portable platform may aid in disease diagnosis and monitoring, epidemiology, and general laboratory tasks. Although methods exist for detecting nucleic acids (1-6), they have trade-offs among sensitivity, specificity, simplicity, cost, and speed. Microbial Clustered Regularly Interspaced Short Palindromic Repeats (CRISPR) and CRISPR-associated (CRISPR-Cas) adaptive immune systems contain programmable endonucleases that can be leveraged for CRISPR-based diagnostics (CRISPR-Dx). While some Cas enzymes target DNA (7, 8), single effector RNA-guided RNases, such as Cas13a (previously known as C2c2) (8), can be reprogrammed with CRISPR RNAs (crRNAs) (9-11) to provide a platform for specific RNA sensing. Upon recognition of its RNA target, activated Cas13a engages in "collateral" cleavage of nearby non-targeted RNAs (10). This crRNA-programmed collateral cleavage activity allows Cas13a to detect the presence of a specific RNA in vivo by triggering programmed cell death (10) or in vitro by nonspecific degradation of labeled RNA (10, 12). Here we describe SHERLOCK (Specific High Sensitivity Enzymatic Reporter UnLOCKing), an in vitro nucleic acid detection platform with attomolar sensitivity based on nucleic acid amplification and 3 Cas13a-mediated collateral cleavage of a commercial reporter RNA (12), allowing for real-time detection of the target (FIG. 17).

Methods

Cloning of C2c2 Loci and Proteins for Expression

For the bacterial in vivo efficiency assay, C2c2 proteins from *Leptotrichia wadei* F0279 and *Leptotrichia shahii* were ordered as codon-optimized genes for mammalian expression (Genscript, Jiangsu, China) and cloned into pACYC184 backbones along with the corresponding direct repeats flanking either a beta-lactamase targeting or non-targeting spacer. Spacer expression was driven by a J23119 promoter.

For protein purification, mammalian codon-optimized C2c2 proteins were cloned into bacterial expression vector for protein purification (6× His/Twin Strep SUMO, a pET-based expression vector received as a gift from Ilya Finkelstein).

Bacterial In Vivo C2c2 Efficiency Assay

LwC2c2 and LshC2c2 in vivo efficiency plasmids and a previously described beta-lactamase plasmid (Abudayyeh 2016) were co-transformed into NovaBlue Singles competent cells (Millipore) at 90 ng and 25 ng, respectively. After transformation, dilutions of cells were plated on ampicillin and choramphicol LB-agar plate and incubated overnight at 37 C. Colonies were counted the next day.

Nucleic Acid Target and crRNA Preparation

Nucleic acid targets were PCR amplified with KAPA Hifi Hot Start (Kapa Biosystems), gel extracted and purified using MinElute gel extraction kit (Qiagen). Purified dsDNA was incubated with T7 polymerase overnight at 30° C. using the HiScribe T7 Quick High Yield RNA Synthesis kit (New England Biolabs) and RNA was purified with the MEGAclear Transcription Clean-up kit (Thermo Fisher).

For preparation of crRNA, constructs were ordered as DNA (Integrated DNA Technologies) with an appended T7 promoter sequence. crRNA DNA was annealed to a short T7 primer (final concentrations 10 uM) and incubated with T7 polymerase overnight at 37° C. using the HiScribe T7 Quick High Yield RNA Synthesis kit (New England Biolabs). crRNA were purified using RNAXP clean beads (Beckman Coulter) at 2× ratio of beads to reaction volume, with an additional 1.8× supplementation of isopropanol (Sigma).

NASBA Isothermal Amplification

Details of NASBA reaction are described in [Pardee 2016]. For a 20 µL total reaction volume, 6.7 µL of reaction buffer (Life Sciences, NECB-24), 3.3 µL of Nucleotide Mix (Life Sciences, NECN-24), 0.5 µL of nuclease-free water, 0.4 µL of 12.5 µM NASBA primers, 0.1 uL of RNase inhibitor (Roche, 03335402001) and 4 µL of RNA amplicon (or water for the negative control) were assembled at 4° C. and incubated 65° C. for 2 min and then 41° C. for 10 min. 5 µL of enzyme mix (Life Sciences, NEC-1-24) was added to each reaction, and the reaction mixture was incubated at 41° C. for 2 hr. NASBA primers used were 5'-AATTCTAATACGACTCACTATAGGGG-GATCCTCTAGAAATATGGATT-3' (SEQ ID NO: 16) and 5'-CTCGTATGTTGTGTGGAATTGT-3' (SEQ ID NO: 17), and the underlined part indicates T7 promoter sequence.

Recombinase Polymerase Amplification

Primers for RPA were designed using NCBI Primer blast (Ye et al., BMC Bioinformaics 13, 134 (2012) using default parameters, with the exception of amplicon size (between 100 and 140 nt), primer melting temperatures (between 54 C and 67 C) and primer size (between 30 and 35 nt). Primers were then ordered as DNA (Integrated DNA Technologies).

RPA and RT-RPA reactions run were as instructed with TwistAmp® Basic or TwistAmp® Basic RT (TwistDx), respectively, with the exception that 280 mM MgAc was added prior to the input template. Reactions were run with 1 uL of input for 2 hr at 37 C, unless otherwise described.

LwC2c2 Protein Purification

C2c2 bacterial expression vectors were transformed into Rosetta™ 2(DE3) pLysS Singles Competent Cells (Millipore). A 16 mL starter culture was grown in Terrific Broth 4 growth media (12 g/L tryptone, 24 g/L yeast extract, 9.4 g/L K2HPO, 2.2 g/L KH2PO4, Sigma) (TB) was used to inoculate 4 L of TB, which was incubated at 37 C, 300 RPM until an OD600 of 0.6. At this time, protein expression was induced by supplementation with IPTG (Sigma) to a final concentration of 500 uM, and cells were cooled to 18 C for 16 h for protein expression. Cells were then centrifuged at 5200 g, 15 min, 4 C. Cell pellet was harvested and stored at −80 C for later purification.

All subsequent steps of the protein purification are performed at 4 C. Cell pellet was crushed and resuspended in lysis buffer (20 mM Tris-Hcl, 500 mM NaCl, 1 mM DTT, pH 8.0) supplemented with protease inhibitors (Complete Ultra EDTA-free tablets), lysozyme, and benzonase followed by sonication (Sonifier 450, Branson, Danbury, Conn.) with the following conditions: amplitude of 100 for 1 second on and 2 seconds off with a total sonication time of 10 minutes. Lysate was cleared by centrifugation for 1 hour at 4 C at 10,000 g and the supernatant was filtered through a Stericup 0.22 micron filter (EMD Millipore). Filtered supernatant was applied to StrepTactin Sepharose (GE) and incubated with rotation for 1 hour followed by washing of of the protein-bound StrepTactin resin three times in lysis buffer. The resin was resuspended in SUMO digest buffer (30 mM Tris-HCl, 500 mM NaCl 1 mM DTT, 0.15% Igepal (NP-40), pH 8.0) along with 250 Units of SUMO protease (ThermoFisher) and incubated overnight at 4 C with rotation. Digestion was confirmed by SDS-PAGE and Commassie Blue staining and the protein eluate was isolated by spinning the resin down. Protein was loaded onto a 5 mL HiTrap SP HP cation exchange column (GE Healthcare Life Sciences) via FPLC (AKTA PURE, GE Healthcare Life Sciences) and eluted over a salt gradient from 130 mM to 2M NaCl in elution buffer (20 mM Tris-HCl, 1 mM DTT, 5% Glycerol, pH 8.0). The resulting fractions were tested for presence of LwC2c2 by SDS-PAGE and fractions containing the protein were pooled and concentrated via a Centrifugal Filter Unit to 1 mL in S200 buffer (10 mM HEPES, 1M NaCl, 5 mM MgCl2, 2 mM DTT, pH 7.0). The concentrated protein was loaded onto a gel filtration column (Superdex® 200 Increase 10/300 GL, GE Healthcare Life Sciences) via FPLC. The resulting fractions from gel filtration were analyzed by SDS-PAGE and fractions containing LwC2c2 were pooled and buffer exchanged into Storage Buffer (600 mM NaCl, 50 mM Tris-HCl pH 7.5, 5% Glycerol, 2 mM DTT) and frozen at −80 C for storage.

LwC2c2 Collateral Detection

Detection assays were performed with 45 nM purified LwC2c2, 22.5 nM crRNA, 125 nM substrate reporter (Thermo Scientific RNAse Alert v2), 2 µL murine RNase inhibitors, 100 ng of background total RNA and varying amounts of input nucleic acid target, unless otherwise indicated, in nuclease assay buffer (40 mM Tris-HCl, 60 mM NaCl, 6 mM MgCl2, pH 7.3). If the input was amplified DNA including a T7 promoter from a RPA reaction, the above C2c2 reaction was modified to include 1 mM ATP, 1 mM GTP, 1 mM UTP, 1 mM CTP and 0.6 µL T7 polymerase mix (NEB). Reactions were allowed to proceed for 1-3 hours at 37° C. (unless otherwise indicated) on a fluorescent plate reader (BioTek) with fluorescent kinetics measured every 5 minutes.

The one-pot reaction combining, RPA-DNA amplification, T7 polymerase conversion of DNA to RNA and C2c2 detection was performed by integrating the reaction conditions above with the RPA amplification mix. Briefly, in a 50 µL one-pot assay consisted of 0.48 µM forward primer, 0.48 µM reverse primer, 1x RPA rehydration buffer, varying amounts of DNA input, 45 nM LwC2c2 recombinant protein, 22.5 nM crRNA, 250 ng background total RNA, 200 nM substrate reporter (RNase alert v2), 4 uL RNase inhibitor, 2 mM ATP, 2 mM GTP, 2 mM UTP, 2 mM CTP, 1 µL T7 polymerase mix, 5 mM MgCl2, and 14 mM MgAc.

Quantitative PCR (qPCR) Analysis with TaqMan Probes

To compare SHERLOCK quantification with other established methods, qPCR on a dilution series of ssDNA 1 was performed. A TaqMan probe and primer set (sequences below) were designed against ssDNA 1 and synthesized with IDT. Assays were performed using the TaqMan Fast Advanced Master Mix (Thermo Fisher) and measured on a Roche LightCycler 480.

TABLE 11

Table of qPCR primer/probe sequences.

| Name | Sequence |
| --- | --- |
| Forward Primer | GTG AAA TTG TGA GCG GAT AAA C (SEQ ID NO: 217) |
| Reverse Primer | AAC AGC AAT CTA CTC GAC CTG (SEQ ID NO: 218) |

TABLE 11-continued

Table of qPCR primer/probe sequences.

| Name | Sequence |
|---|---|
| TaqMan Probe | /56-FAM/AGGAAACAG/ZEN/CTATGACCAT GATTACGCC/3IABkFQ/ (SEQ ID NO: 219) |

Real-Time RPA with SYBR Green II

To compare SHERLOCK quantification with other established methods, we performed RPA on a dilution series of ssDNA 1. To quantitate accumulation of DNA in real-time, we added 1×SYBR Green II (Thermo Fisher) to the typical RPA reaction mixture described above, which provides a fluorescent signal that correlates with the amount of nucleic acid. Reactions were allowed to proceed for 1 hr at 37° C. on a fluorescent plate reader (BioTek) with fluorescent kinetics measured every 5 min.

Lentivirus Preparation and Processing

Lentivirus preparation and processing was based on the previously known methods. Briefly, 10 µg pSB700 derivatives that include a Zika or Dengue RNA fragment, 7.5 µg psPAX2, and 2.5 µg pMD2.G were transfected to HEK293FT cells (Life Technologies, R7007) using the HeBS-CaCl2 method. 28 hr after changing media, DMEM supplemented with 10% FBS, 1% penicillin-streptomycin and 4 mM GlutaMAX (ThermoFisher Scientific), the supernatant was filtered using a 0.45 µm syringe filter. ViralBind Lentivirus Purification Kit (Cell Biolabs, VPK-104) and Lenti-X Concentrator (Clontech, 631231) were used to purify and prepare lentiviruses from the supernatant. Viral concentration was quantified using QuickTiter Lentivirus Kit (Cell Biolabs, VPK-112). Viral samples were spiked into 7% human serum (Sigma, H4522), were heated to 95° C. for 2 min and were used as input to RPA.

Isolation and cDNA Purification of Zika Human Serum Samples

Suspected Zika positive human serum or urine samples were inactivated with AVL buffer (Qiagen) and isolation of RNA was achieved with QIAamp Viral RNA minikit (Qiagen). Isolated RNA was converted into cDNA by mixing random primers, dNTPs, and sample RNA followed by heat denaturation for 7 minutes at 70° C. Denatured RNA was then reverse transcribed with Superscript III (Invitrogen) incubating at 22-25° C. for 10 minutes, 50° C. for 45 minutes, 55° C. for 15 minutes, and 80° C. for 10 minutes. cDNA was then incubated for 20 minutes at 37° C. with RNAse H (New England Biolabs) to destroy RNA in the RNA:cDNA hybrids.

Genomic DNA Extraction from Human Saliva 2 mL of saliva was collected from volunteers, who were restricted from consuming food or drink 30 minutes prior to collection. Samples were then processed using QIAamp® DNA Blood Mini Kit (Qiagen) as recommended by the kit protocol. For boiled saliva samples, 400 µL of phosphate buffered saline (Sigma) was added to 100 µL of volunteer saliva and centrifuged for 5 min at 1800 g. The supernatant was decanted and the pellet was resuspended in phosphate buffered saline with 0.2% Triton X-100 (Sigma) before incubation at 95° C. for 5 min. 1 µL of sample was used as direct input into RPA reactions.

Freeze-Drying and Paper Deposition

A glass fiber filter paper (Whatman, 1827-021) was autoclaved for 90 min (Consolidated Stills and Sterilizers, MKII) and was blocked in 5% nuclease-free BSA (EMD Millipore, 126609-10GM) overnight. After rinsing the papers once with nuclease-free water (Life technologies, AM9932), they were incubated with 4% RNAsecure™ (Life technologies, AM7006) at 60° C. for 20 min and were rinsed three more times with the nuclease-free water. Treated papers were dried for 20 min at 80° C. on a hot plate (Cole-Parmer, IKA C-Mag HS7) prior to use. 1.8 µL of C2c2 reaction mixture as indicated earlier was put onto the disc (2 mm) that was placed in black, clear bottom 384-well plate (Corning, 3544). For the freeze-dried test, the plate containing reaction mixture discs was flash frozen in liquid nitrogen and was freeze-dried overnight as described in Pardee et al (2). RPA samples were diluted 1:10 in nuclease-free water, and 1.8 µL of the mixture was loaded onto the paper discs and incubated at 37° C. using a plate reader (BioTek Neo).

Bacterial Genomic DNA Extraction

For experiments involving CRE detection, bacterial cultures were grown in lysogeny broth (LB) to mid-log phase, then pelleted and subjected to gDNA extraction and purification using the Qiagen DNeasy Blood and Tissue Kit, using the manufacturer's protocol for either Gram negative or Gram positive bacteria, as appropriate. gDNA was quantified by the Quant-It dsDNA assay on a Qubit fluorometer and its quality assessed via 200-300 nm absorbance spectrum on a Nanodrop spectrophotometer.

For experiments discriminating between E. coli and P. aeruginosa, bacterial cultures were grown to early stationary phase in Luria-Bertani (LB) broth. 1.0 mL of both E. coli and P. aeruginosa were processed using the portable PureLyse bacteria gDNA extraction kit (Claremont BioSolutions). 1× binding buffer was added to the bacterial culture before passing through the battery-powered lysis cartridge for three minutes. 0.5×binding buffer in water was used as a wash solution before eluting with 150 µL of water.

Digital Droplet PCR Quantification

To confirm the concentration of ssDNA 1 and ssRNA 1 standard dilutions used in FIG. 1C, we performed digital-droplet PCR (ddPCR). For DNA quantification, droplets were made using the ddPCR Supermix for Probes (no dUTP) with PrimeTime qPCR probes/primer assays designed to target the ssDNA 1 sequence. For RNA quantification, droplets were made using the one-step RT-ddPCR kit for probes with PrimeTime qPCR probes/primer assays designed to target the ssRNA 1 sequence. Droplets were generated in either case using the QX200 droplet generator (BioRad) and transferred to a PCR plate. Droplet-based amplification was performed on a thermocycler as described in the kit's protocol and nucleic acid concentrations were subsequently determined via measurement on a QX200 droplet reader.

Synthetic Standards for Human Genotyping

To create standards for accurate calling of human sample genotypes, we designed primers around the SNP target to amplify ~200 bp regions from human genomic DNA representing each of the two homozygous genotypes. The heterozygous standard was then made by mixing the homozygous standards in a 1:1 ratio. These standards were then diluted to equivalent genome concentrations (~0.56 fg/µL) and used as input for SHERLOCK alongside real human samples.

Detection of Tumor Mutant Cell Free-DNA (cfDNA)

Mock cfDNA standards simulating actual patient cfDNA samples were purchased from a commercial vendor (Horizon Discovery Group). These standards were provided as four allelic fractions (100% WT and 0.1%, 1%, and 5% mutant) for both the BRAF V600E and EGFR L858R mutants. 3 μL of these standards were provided as input to SHERLOCK.

Analysis of Fluorescence Data

To calculate background subtracted fluorescence data, the initial fluorescence of samples was subtracted to allow for comparisons between different conditions. Fluorescence for background conditions (either no input or no crRNA conditions) were subtracted from samples to generate background subtracted fluorescence.

Guide ratios for SNP or strain discrimination were calculated by dividing each guide by the sum of guide values, to adjust for sample-to-sample overall variation. crRNA ratios for SNP or strain discrimination were calculated to adjust for sample-to-sample overall variation as follows:

$$\text{crRNA } A_i \text{ ratio} = \frac{(m+n)A_t}{\sum_{i=1}^{m} A_i + \sum_{i=1}^{n} B_i}$$

where Ai and Bi refer to the SHERLOCK intensity values for technical replicate i of the crRNAs sensing allele A or allele B, respectively, for a given individual. Since we typically have four technical replicates per crRNA, m and n are equal to 4 and the denominator is equivalent to the sum of all eight of the crRNA SHERLOCK intensity values for a given SNP locus and individual. Because there are two crRNAs, the crRNA ratio average across each of the crRNAs for an individual will always sum to two. Therefore, in the ideal case of homozygosity, the mean crRNA ratio for the positive allele crRNA will be two and the mean crRNA ratio for the negative allele crRNA will be zero. In the ideal case of heterozygosity, the mean crRNA ratio for each of the two crRNAs will be one.

Characterization of LwCas13a Cleavage Requirements.

The protospacer flanking site (PFS) is a specific motif present near the target site that is required for robust ribonuclease activity by Cas13a. The PFS is located at the 3' end of the target site and was previously characterized for LshCas13a by our group as H (not G) (1). Although this motif is akin to a protospacer adjacent motif (PAM), a sequence restriction for DNAtargeting Class 2 systems, it is functionally different as it not involved in preventing self-targeting of CRISPR loci in endogenous systems. Future structural studies of Cas13a will likely elucidate the importance of the PFS for Cas13a:crRNA target complex formation and cleavage activity.

Figure 2:
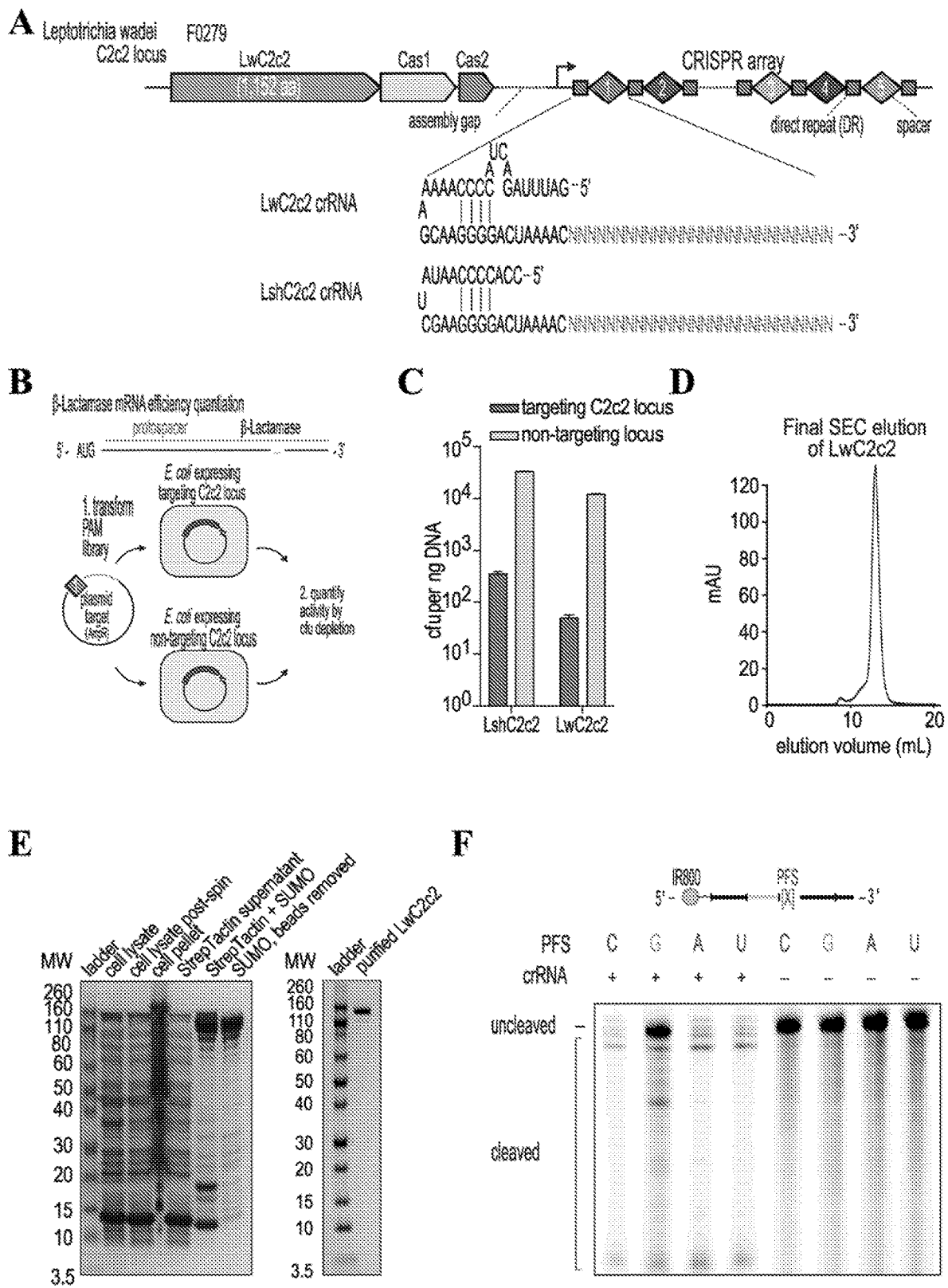
FIG. 2—provides (A) schematic of the CRISPR/C2c2 locus from *Leptotrichia wadei*. Representative crRNA structures from LwC2c2 and LshC2c2 systems are shown. (SEQ. I.D. Nos. 220 and 221) (B) Schematic of in vivo bacterial assay for C2c2 activity. A protospacer is cloned upstream of the beta-lactamase gene in an ampicillin-resistance plasmid, and this construct is transformed into *E. coli* expressing C2c2 in conjunction with either a targeting or non-targeting spacer. Successful transformants are counted to quantify activity. (C) Quantitation of LwC2c2 and LshC2c2 in vivo activity. (n=2 biological replicates; bars represent mean±s.e.m.) (D) Final size exclusion gel filtration of LwC2c2. (E) Coomassie blue stained acrylamide gel of LwC2c2 stepwise purification. (F) Activity of LwC2c2 against different PFS targets. LwC2c2 was targeted against fluorescent RNA with variable 3' PFS flanking the spacer, and reaction products were visualized on denaturing gel. LwC2c2 shows a slight preference against G PFS.
Figure 3:
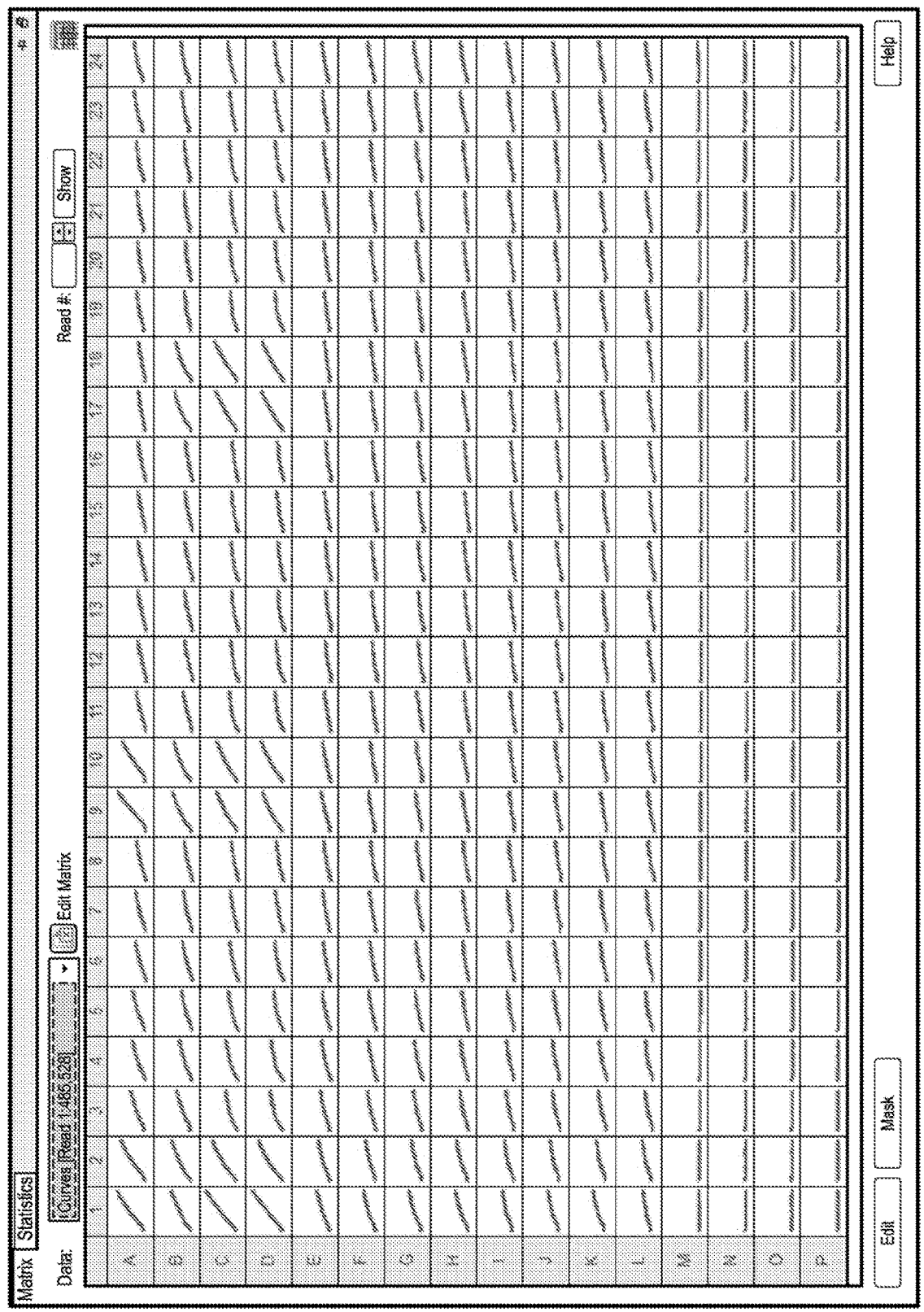
FIG. 3—Shows detection of an example masking construct at different dilutions using 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.
Figure 4:
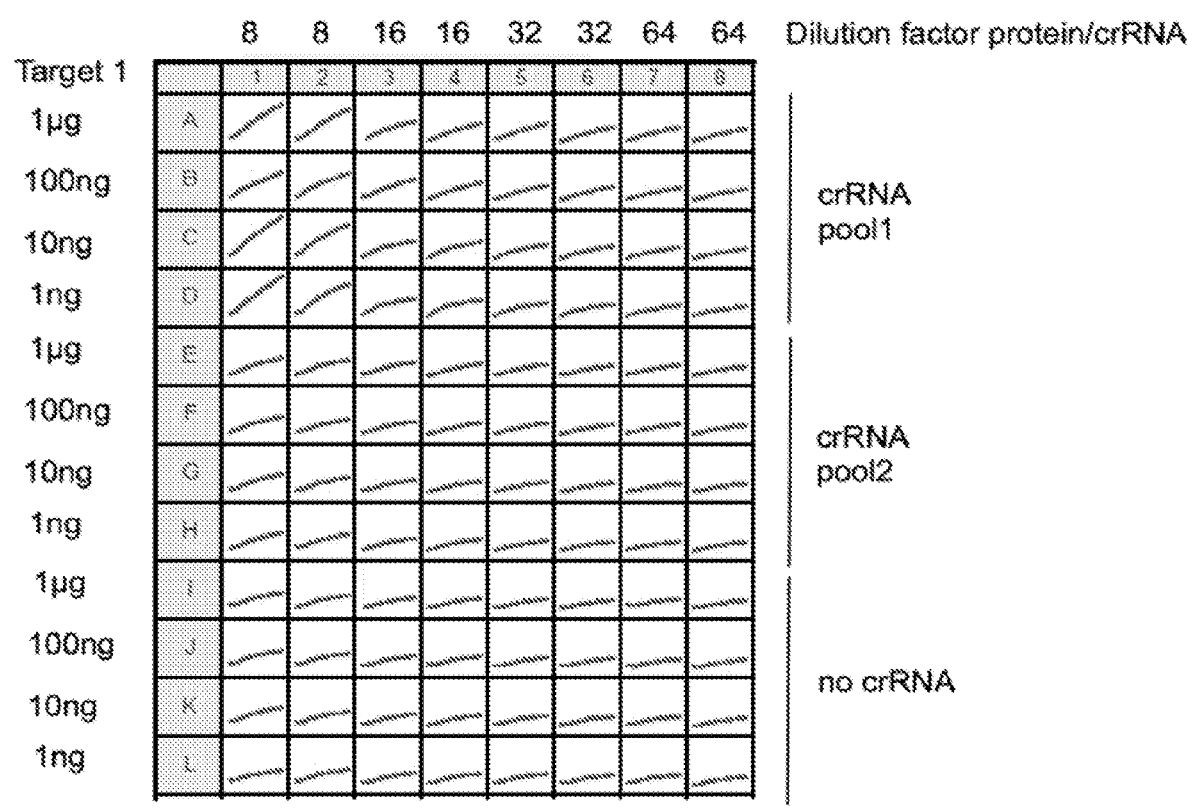
FIG. 4—Shows detection of an example masking construct at different dilutions using 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.
Figure 5:
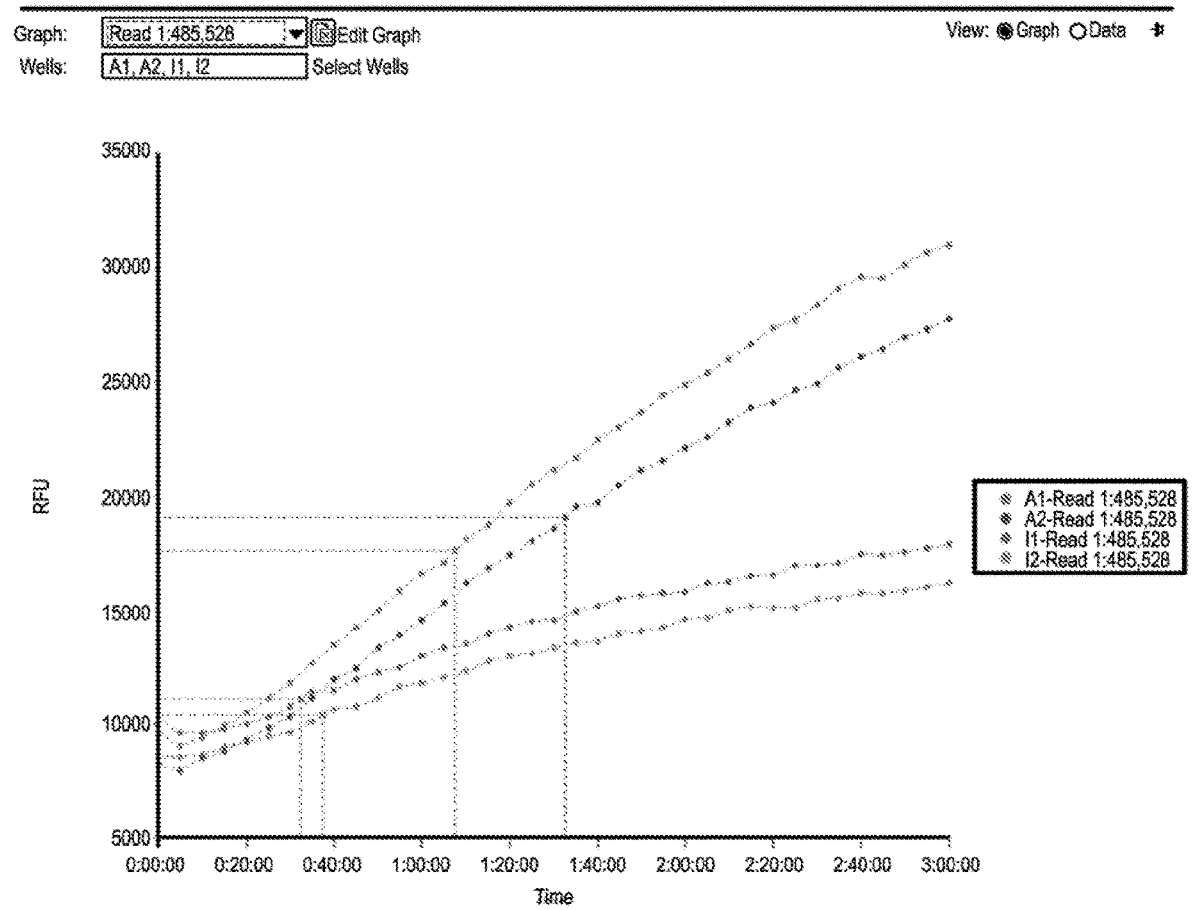
FIG. 5—Shows detection of an example masking construct at different dilutions using 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.
Figure 6:
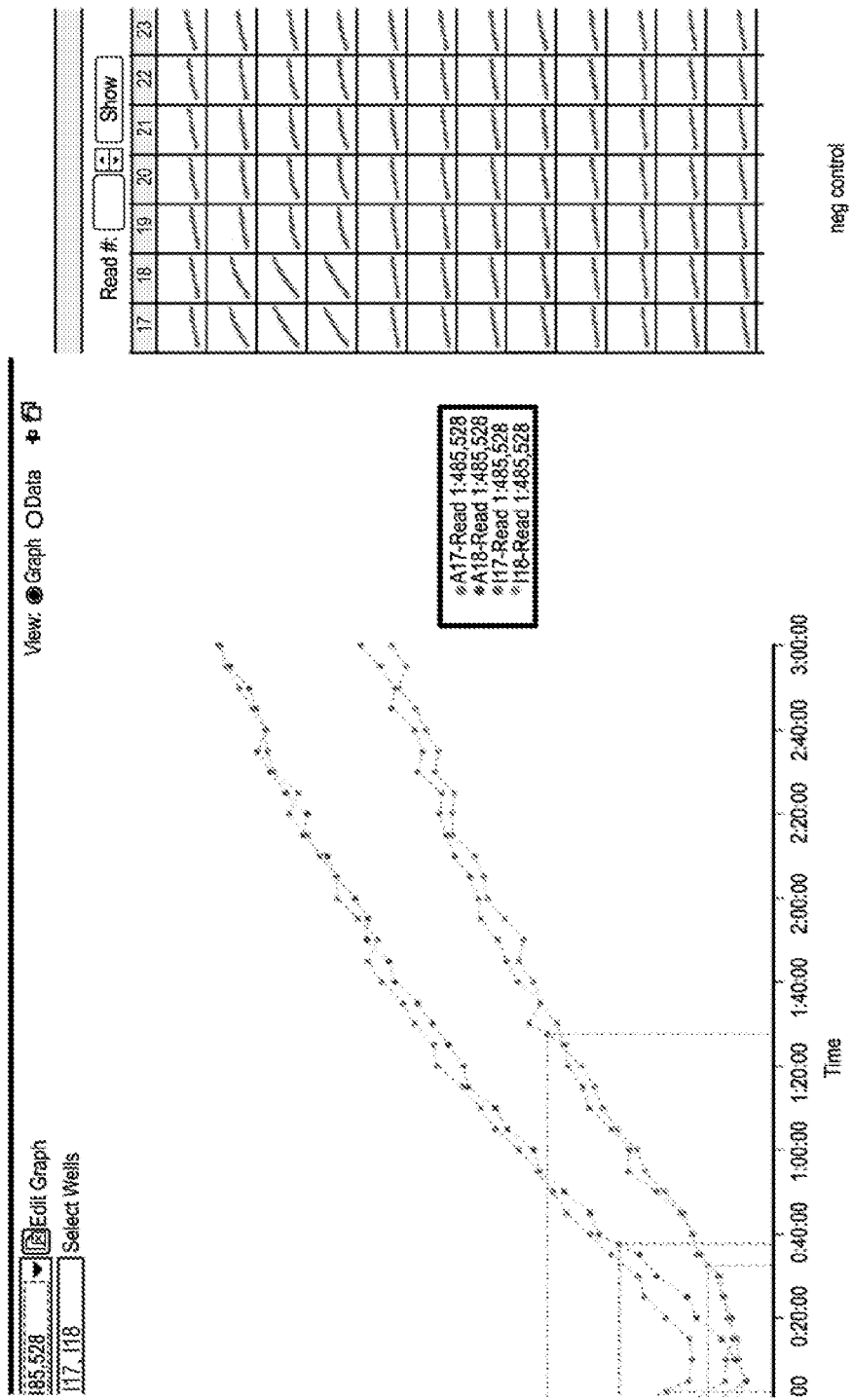
FIG. 6—Shows detection of an example masking construct at different dilutions using 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.
Figure 7:
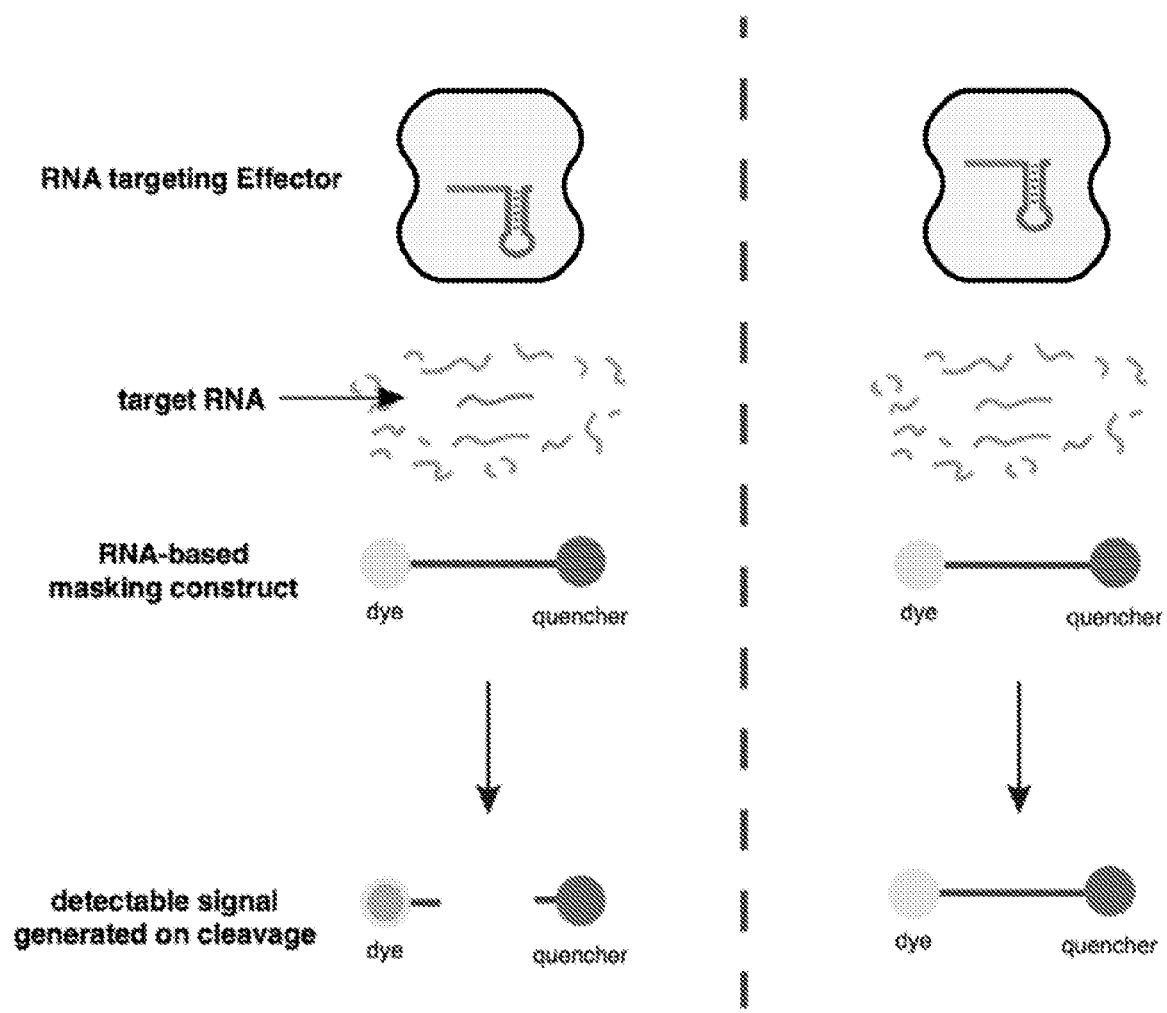
FIG. 7—provides a schematic of an example detection scheme using a masking construct and CRISPR effector protein, in accordance with certain example embodiments.
Figure 8:
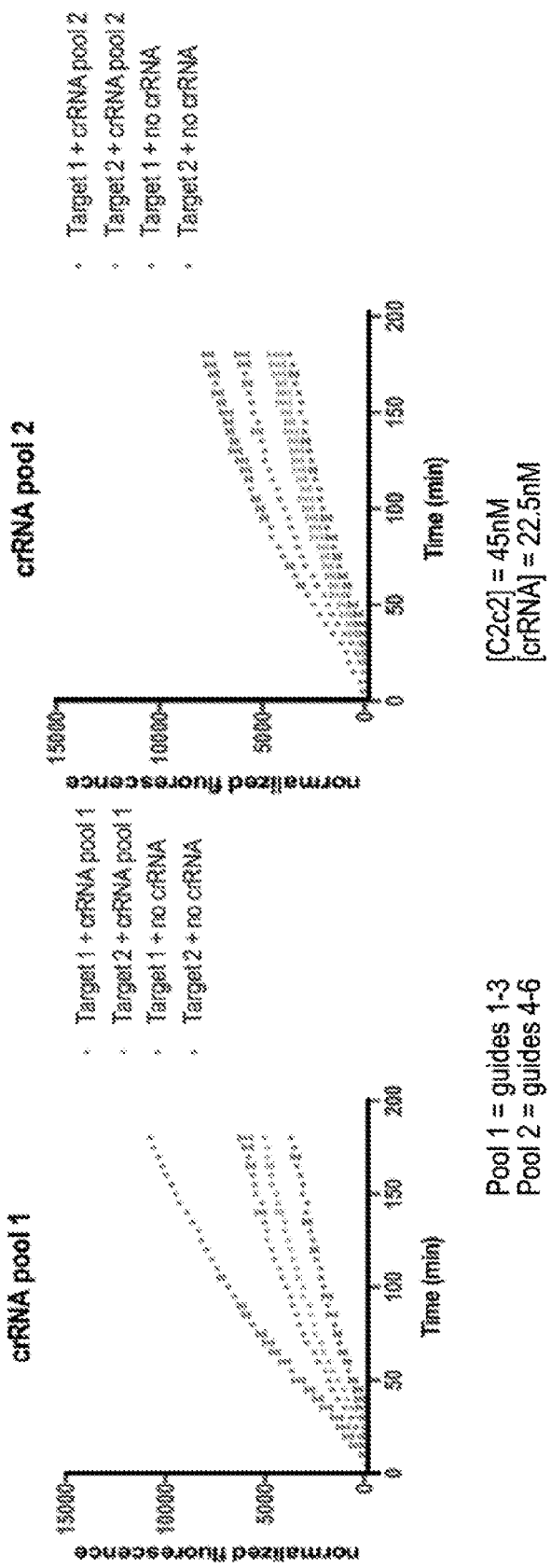
FIG. 8—provides a set of graphs showing changes in fluorescence over time when detecting a target using different pools of guide RNAs.
Figure 9:
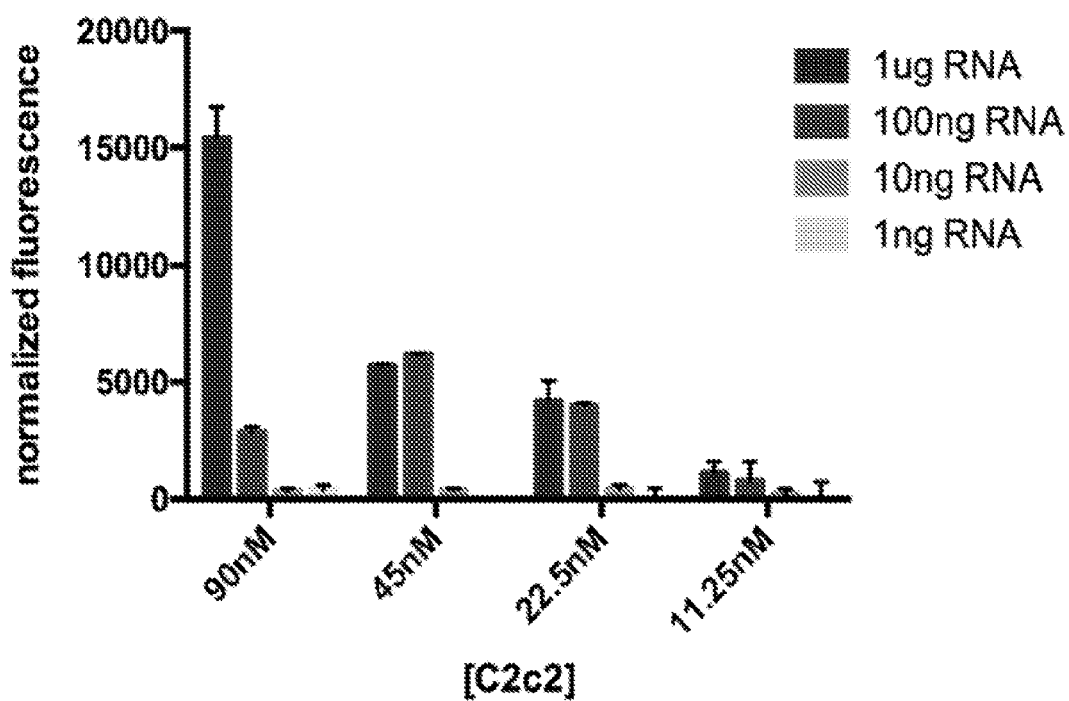
FIG. 9—provides a graph showing the normalized fluorescence detected across different dilutions of target RNA at varying concentrations of CRISPR effector protein.

We purified the recombinant LwCas13a protein from *E. coli* (FIG. 2D-E) and assayed its ability to cleave a 173-nt ssRNA with each possible protospacer flanking site (PFS) nucleotide (A, U, C or G) (FIG. 2F). Similar to LshCas13a, LwCas13a can robustly cleave a target with A, U, or C PFS, with less activity on the ssRNA with a G PFS. Although we see weaker activity against ssRNA 1 with a G PFS, we still see robust detection for the two target sites with G PFS motifs (Table 3; rs601338 crRNA and Zika targeting crRNA 2). It is likely that the H PFS is not required under every circumstance and that in many cases strong cleavage or collateral activity can be achieved with a G PFS.

Discussion of Recombinase Polymerase Amplification (RPA) and Other Isothermal Amplification Strategies.

Recombinase polymerase amplification (RPA) is an isothermal amplification technique consisting of three essential enzymes: a recombinase, single-stranded DNA-binding proteins (SSBs), and a strand displacing polymerase. RPA overcomes many technical difficulties present in other amplification strategies, particularly polymerase chain reaction (PCR), by not requiring temperature regulation as the enzymes all operate at a constant temperature around 37° C. RPA replaces temperature cycling for global melting of the double-stranded template and primer annealing with an enzymatic approach inspired by in vivo DNA replication and repair. Recombinase-primer complexes scan double-stranded DNA and facilitate strand exchange at complementary sites. The strand exchange is stabilized by SSBs, allowing the primer to stay bound. Spontaneous disassembly of the recombinase occurs in its ADP-bound state, allowing a strand-displacing polymerase to invade and extend the primer, allowing amplification without complex instrumentation unavailable in point-of-care and field settings. Cyclic repetition of this process in a temperate range of 37-42° C. results in exponential DNA amplification. The original formulation published uses the *Bacillus subtilis* Pol I (Bsu) as the strand-displacing polymerase, T4 uvsX as the recombinase, and T4 gp32 as the single-stranded DNA binding protein (2), although it is unclear what components are in the current formulation sold by TwistDx used in this study.

Figure 15:
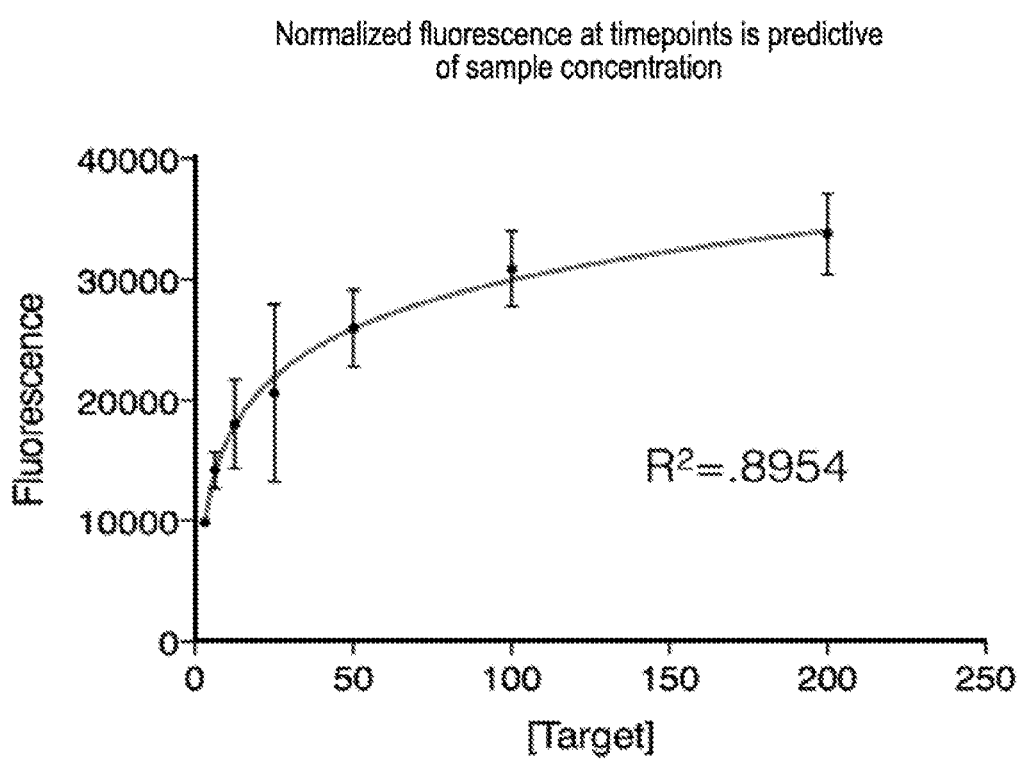
FIG. 15—Shows that normalized fluorescence at particular time points is predictive of sample input concentration. Fluorescence measurements from Cas13a detection without amplification are correlated with input RNA concentration (n=2 biological replicates; bars represent mean±s.e.m.).
Figure 16:
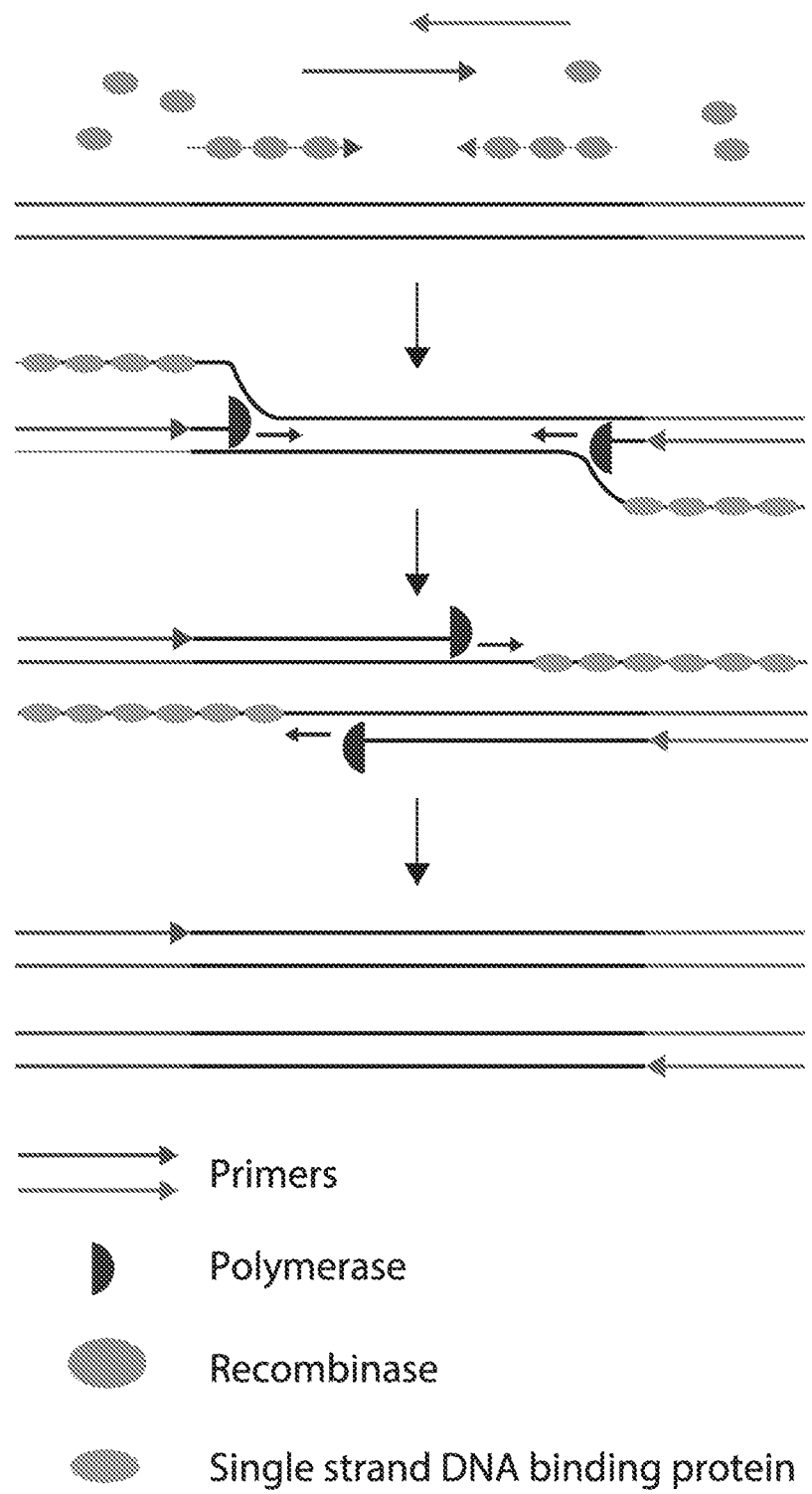
FIG. 16—provides a schematic of the RPA reaction, showing the participating components in the reaction.
Figure 32:
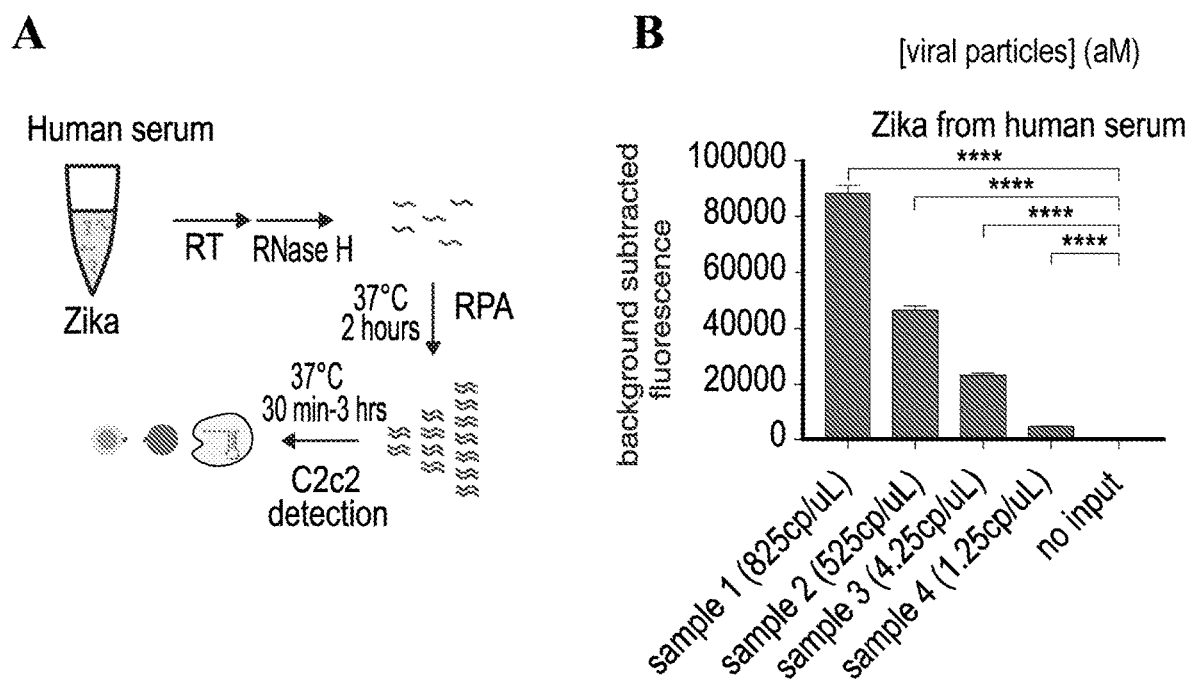
FIG. 32—provides a set of graphs demonstrating (A) A schematic for C2c2 detection of Zika RNA isolated from human serum. Zika RNA in serum is subjected to reverse transcription, RNase H degradation of the RNA, RPA of the cDNA, and C2c2 detection. (B) C2c2 is capable of highly sensitive detection of human Zika serum samples. Concentrations of Zika RNA shown were verified by qPCR (n=4 technical replicates, two-tailed Student t-test; ****, p<0.0001; bars represent mean±s.e.m.).

Additionally, RPA may have a number of limitations:

1) Although Cas13a detection is quantitative (FIG. 15), real-time RPA quantitation can be difficult because of its rapid saturation when the recombinase uses all available ATP. While real-time PCR is quantitative because of the ability to cycle amplification, RPA has no mechanism to tightly control the rate of amplification. Certain adjustments can be made to reduce amplification speed, such as reducing available magnesium or primer concentrations, lowering the reaction temperature, or designing inefficient primers. Although we see some instances of quantitative SHERLOCK, such as in FIGS. 31, 32, and 52, it is not always the case and depends on the template.

2) RPA efficiency can be sensitive to primer design. The manufacturer typically recommends designing longer primers to ensure efficient recombinase binding with average GC content (40-60%) and screening up to 100 primer pairs to find highly sensitive primer pairs. We have found with SHERLOCK that we only have to design two primer pairs to achieve an attomolar test with single molecule sensitivity. This robustness is likely due to the additional amplification of signal by constitutively active Cas13a collateral activity that offsets any inefficiencies in amplicon amplification. This quality is particularly important for our bacterial pathogen identification in FIG. 34. Issues were experienced with amplifying highly structured regions such as the 16S rRNA gene sites in bacterial genomes because there is no melting step involved in RPA. Thus, secondary structure in primers becomes an issue, limiting amplification efficiency and thus sensitivity. The embodiments disclosed herein were believd to be successful despite these RPA-specific issues because of additional signal amplification from Cas13a.

3) The amplification sequence length must be short (100-200 bp) for efficient RPA. For most applications, this is not a significant issue and perhaps is even advantageous (e.g. cfDNA detection where average fragment size is 160 bp). Sometimes large amplicon lengths are important, such as when universal primers are desired for bacterial detection and the SNPs for discrimination are spread over a large area.

SHERLOCK's modularity allows any amplification technique, even non-isothermal approaches, to be used prior to T7 transcription and Cas13a detection. This modularity is enabled by the compatibility of the T7 and Cas13a steps in a single reaction allowing detection to be performed on any amplified DNA input that has a T7 promoter. Prior to using RPA, nucleic acid sequence based amplification (NASBA)

Figure 10:
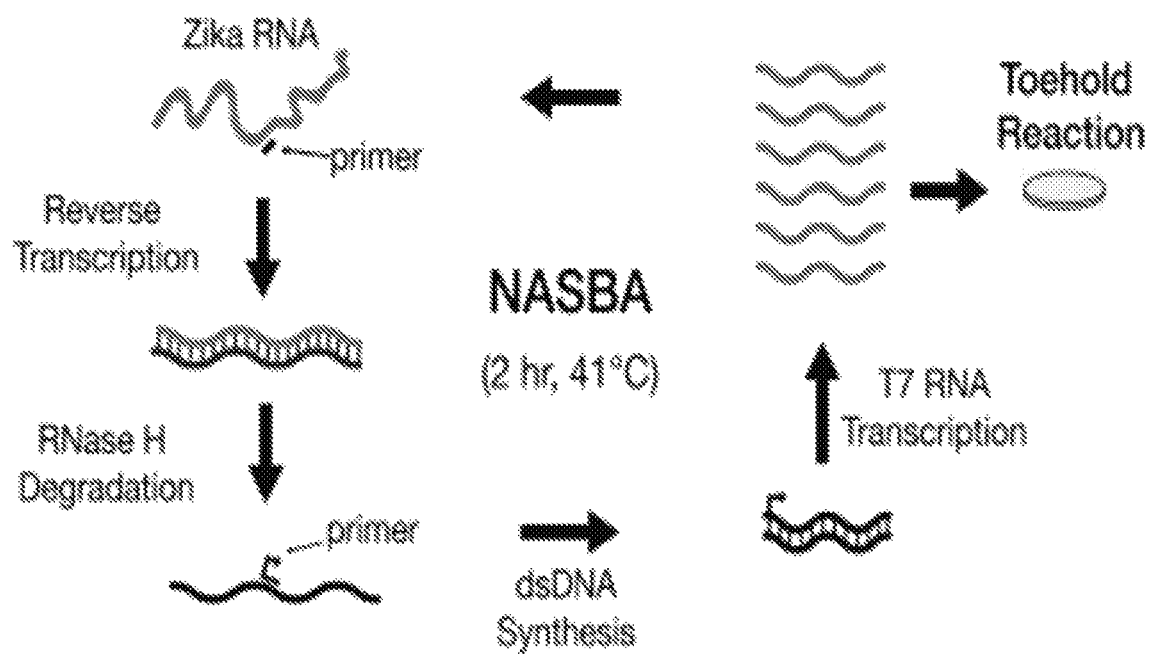
FIG. 10—is a schematic showing the general steps of a NASBA amplification reaction.
Figure 11:
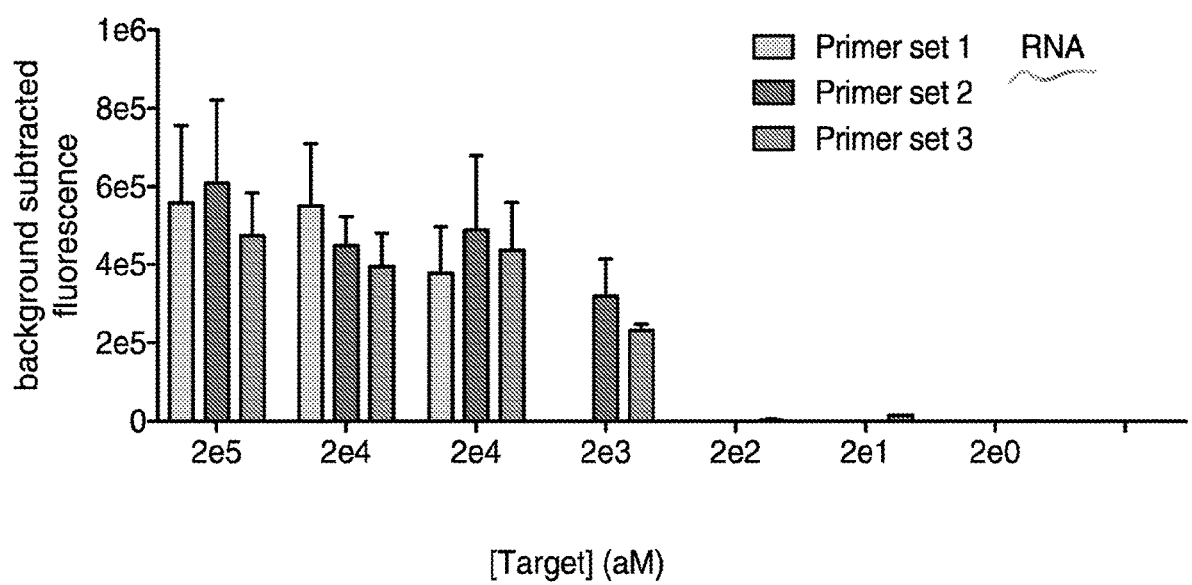
FIG. 11—provides a graph showing detection of nucleic acid target ssRNA 1 amplified by NASBA with three different primer sets and then subjected to C2c2 collateral detection using a quenched fluorescent probe (n=2 technical replicates; bars represent mean±s.e.m.).
Figure 12:
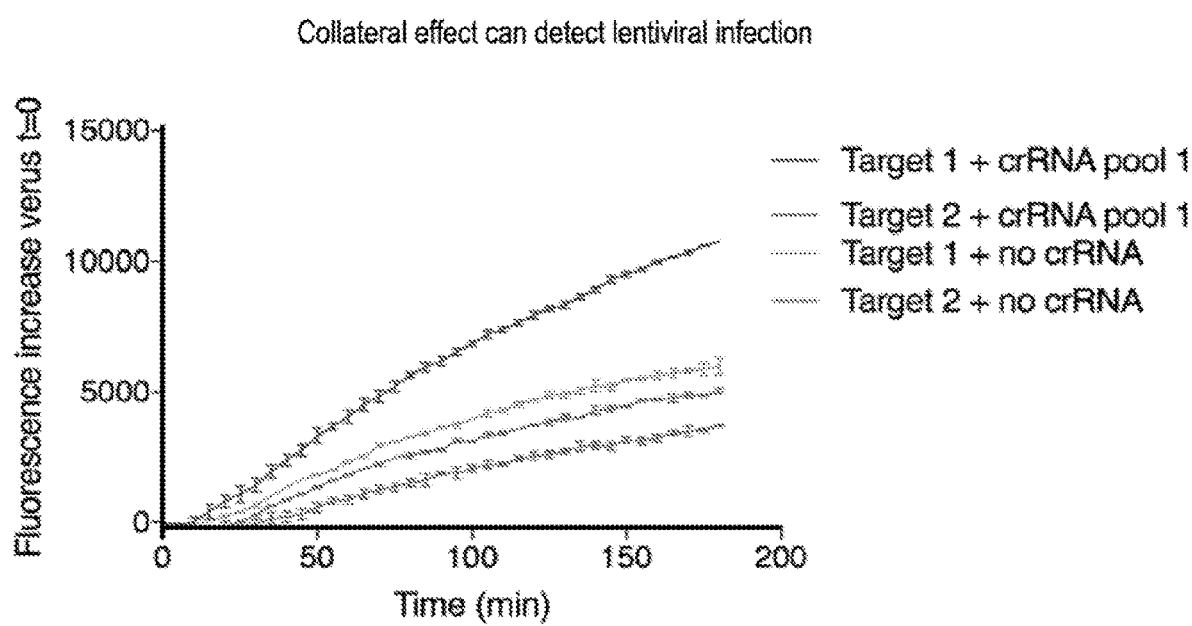
FIG. 12—provides a graph showing that the collateral effect may be used to detect the presence of a lentiviral target RNA.
Figure 13:
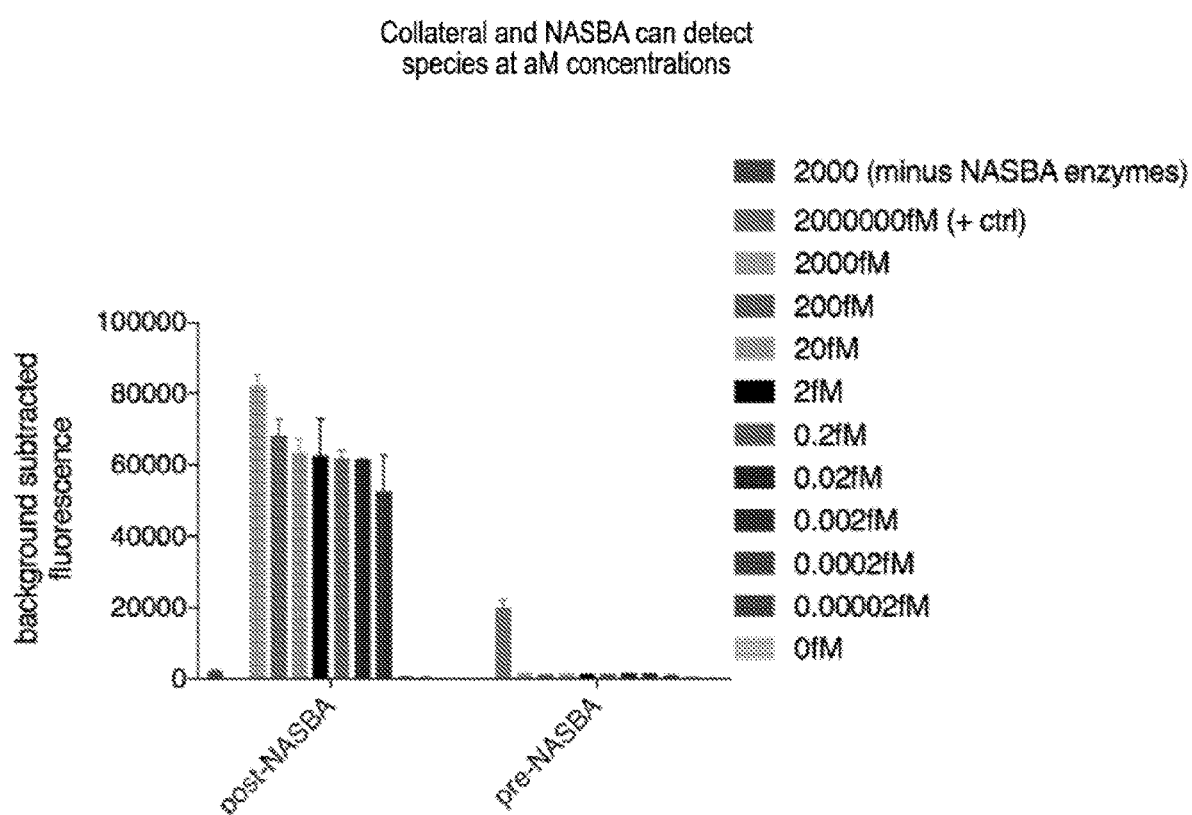
FIG. 13—provides a graph demonstrating that the collateral effect and NASBA can detect species at aM concentrations.
Figure 14:
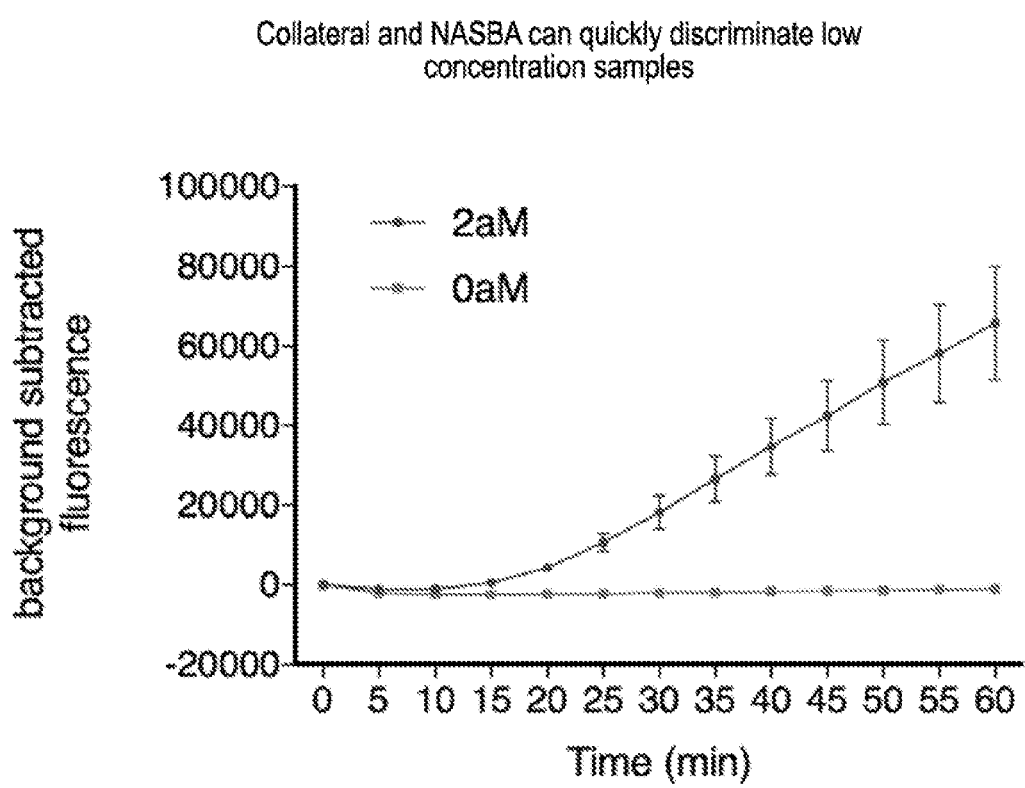
FIG. 14—provides a graph demonstrating that the collateral effect and NASBA quickly discriminate low concentration samples.

(3, 4) was attempted for our detection assay (FIG. 10). However NASBA did not drastically improve the sensitivity of Cas13a (FIGS. 11 and 53). Other amplification techniques that could be employed prior to detection include PCR, loop mediated isothermal amplification (LAMP) (5), strand displacement amplification (SDA) (6), helicase-dependent amplification (HDA) (7), and nicking enzyme amplification reaction (NEAR) (8). The ability to swap any isothermal technique allows SHERLOCK to overcome the specific limitations of any one amplification technique.

Design of Engineered Mismatches.

We previously showed that LshCas13a target cleavage was reduced when there were two or more mismatches in the target:crRNA duplex but was relatively unaffected by single mismatches, an observation we confirmed for LwCas13a collateral cleavage (FIG. 36A). We hypothesized that by introducing an additional mutation in the crRNA spacer sequence, we would destabilize collateral cleavage against a target with an additional mismatch (two mismatches in total) while retaining on-target collateral cleavage, as there would only be a single mismatch. To test the possibility of engineering increased specificity, we designed multiple crRNAs targeting ssRNA 1 and included mismatches across the length of the crRNA (FIG. 36A) to optimize on-target collateral cleavage and minimize collateral cleavage of a target that differs by a single mismatch. We observed that these mismatches did not reduce collateral cleavage of ssRNA 1, but significantly decreased signal for a target that included an additional mismatch (ssRNA 2). The designed crRNA that best distinguished between ssRNA 1 and 2 included synthetic mismatches close to the ssRNA 2 mismatch, in effect creating a "bubble," or distortion in the hybridized RNA. The loss of sensitivity caused by the coordination of a synthetic mismatch and an additional mismatch present in the target (i.e., a double mismatch) agrees with the sensitivity of LshCas13a and LwCas13a to consecutive or nearby double mismatches and presents a basis for rational design of crRNAs that enable single-nucleotide distinction (FIG. 36B).

For mismatch detection of ZIKV and DENV strains, our full-length crRNA contained two mismatches (FIG. 37A,B). Due to high sequence divergence between strains, we were unable to find a continuous stretch of 28 nt with only a single nucleotide difference between the two genomes. However, we predicted that shorter crRNAs would still be functional, and designed shorter 23 nt crRNAs against targets in the two ZIKV strains that included a synthetic mismatch in the spacer sequence and only one mismatch in the target sequence. These crRNAs could still distinguish African and American strains of ZIKV (FIG. 36C). Subsequent testing of 23 nt and 20 nt crRNA show that reductions of spacer length reduce activity but maintain or enhance the ability to discriminate single mismatches (FIG. 57A-G). To better understand how synthetic mismatches may be introduced to facilitate single-nucleotide mutation discrimination, we tiled the synthetic mismatch across the first seven positions of the spacer at three different spacer lengths: 28, 23, and 20 nt (FIG. 57A). On a target with a mutation at the third position, LwCas13a shows maximal specificity when the synthetic mismatch is in position 5 of the spacer, with improved specificity at shorter spacer lengths, albeit with lower levels of on-target activity (FIG. 57B-G). We also shifted the target mutation across positions 3-6 and tiled synthetic mismatches in the spacer around the mutation (FIG. 58).

Genotyping with SHERLOCK Using Synthetic Standards.

Evaluation of synthetic standards created from PCR amplification of the SNP loci allows for accurate identification of genotypes (FIG. 60A,B). By computing all comparisons (ANOVA) between the SHERLOCK results of an individual's sample and the synthetic standards, each individual's genotype can be identified by finding the synthetic standard that has the most similar SHERLOCK detection intensity (FIG. 60C,D). This SHERLOCK genotyping approach is generalizable to any SNP locus (FIG. 60E).

SHERLOCK is an Affordable, Adaptable CRISPR-Dx Platform.

For the cost analysis of SHERLOCK, reagents determined to be of negligible cost were omitted, including DNA templates for the synthesis of crRNA, primers used in RPA, common buffers (MgCl2, Tris HCl, glycerol, NaCl, DTT), glass microfiber filter paper, and RNAsecure reagent. For DNA templates, ultramer synthesis from IDT provides material for 40 in vitro transcription reactions (each being enough for ~10,000 reactions) for ~$70, adding negligible cost to crRNA synthesis. For RPA primers, a 25 nmole IDT synthesis of a 30 nt DNA primer can be purchased for ~$10, providing material adequate for 5000 SHERLOCK reactions. Glass microfiber paper is available for $0.50/sheet, which is sufficient for several hundred SHERLOCK reactions. 4% RNAsecure reagent costs $7.20/mL, which is sufficient for 500 tests.

In addition, for all experiments, except the paper-based assays, 384-well plates were used (Corning 3544), at the cost of $0.036/reaction. Because of the negligible cost, this was not included in the overall cost analysis. Additionally, SHERLOCK-POC does not require the use of a plastic vessel, as it can easily be performed on paper. The readout method for SHERLOCK used herein was a plate reader equipped with either a filter set or a monochromator. As a capital investment, the cost of the reader was not included in the calculation, as the cost precipitously decreases as more reactions are run on the instrument and is negligible. For POC applications, cheaper and portable alternatives could be used, such as hand-held spectrophotometers (9) or portable electronic readers (4), which reduce the cost of instrumentation to <$200. While these more portable solutions will reduce the speed and ease of readout as compared to bulkier instruments, they allow for more broad use.

Results

The assay and systems described herein may generally comprise a two-step process of amplification and detection. During the first step, the nucleic acid sample, either RNA or DNA, is amplified, for example by isothermal amplification. During the second step, the amplified DNA is transcribed into RNA and subsequently incubated with a CRISPR effector, such as C2c2, and a crRNA programmed to detect the presence of the target nucleic acid sequence. To enable detection, a reporter RNA that has been labeled with a quenched fluorophore is added to the reaction. Collateral cleavage of the reporter RNA results in un-quenching of the fluorophore and allows for real-time detection of the nucleic acid target (FIG. 17A).

To achieve robust signal detection, an ortholog of C2c2 was identified from the organism *Leptotrichia wadei* (LwC2c2) and evaluated. The activity of the LwC2c2 protein was evaluated by expressing it along with a synthetic CRISPR array in *E. coli* and programming it to cleave a target site within the beta-lactamase mRNA, which leads to death of the bacteria under ampicillin selection (FIG. 2B). Fewer surviving *E. coli* colonies were observed with the LwC2c2 locus than with the LshC2c2 locus, demonstrating a higher cleavage activity of the LwC2c2 ortholog (FIG. 2C). The human-codon optimized LwC2c2 protein was then purified from *E. coli* (FIG. 2D-E) and its ability to cleave a 173-nt ssRNA assayed with different protospacer flanking site (PFS) nucleotides (FIG. 2F). LwC2c2 was able to cleave each of the possible four PFS targets, with slightly less activity on the ssRNA with a G PFS.

Figure 18:
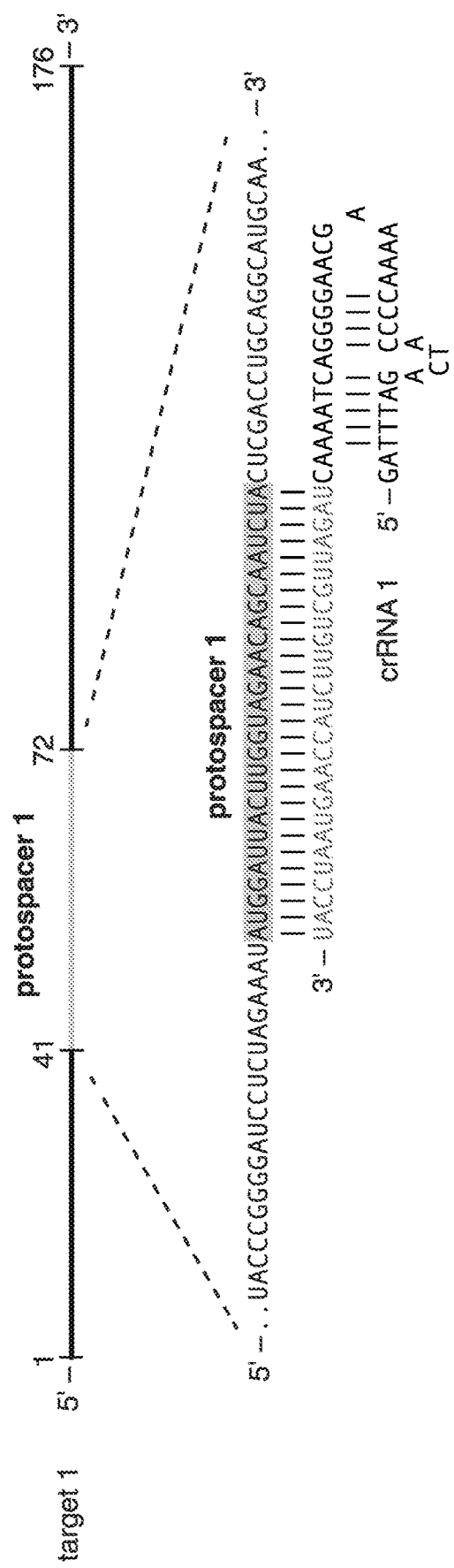
FIG. 18—provides a schematic of ssRNA target detected via the C2c2 collateral detection (SEQ. I.D. Nos. 222 and 223).
Figure 19:
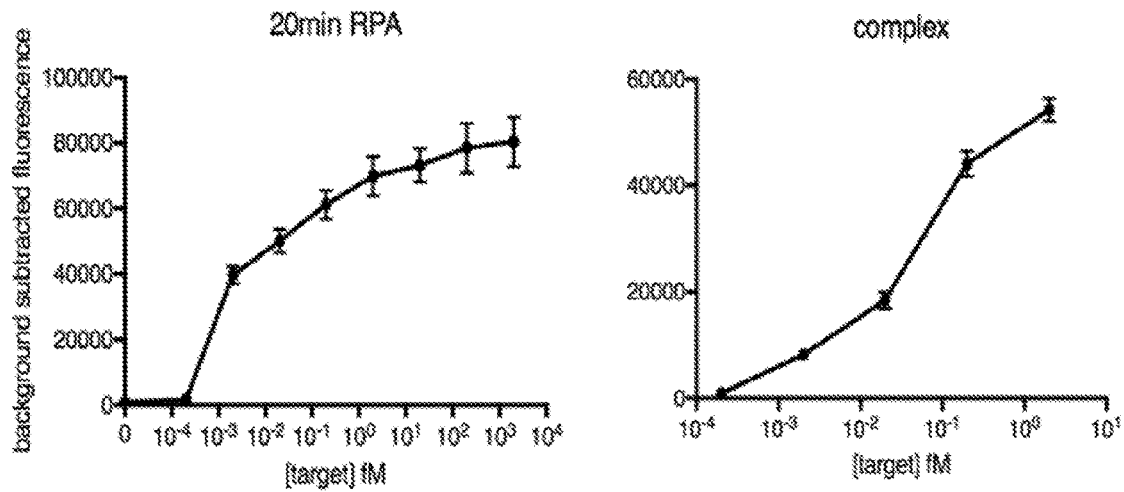
FIG. 19—provides a set of graphs demonstrating single molecule DNA detection using RPA (i.e. within 15 minutes of C2c2 addition).
Figure 20:
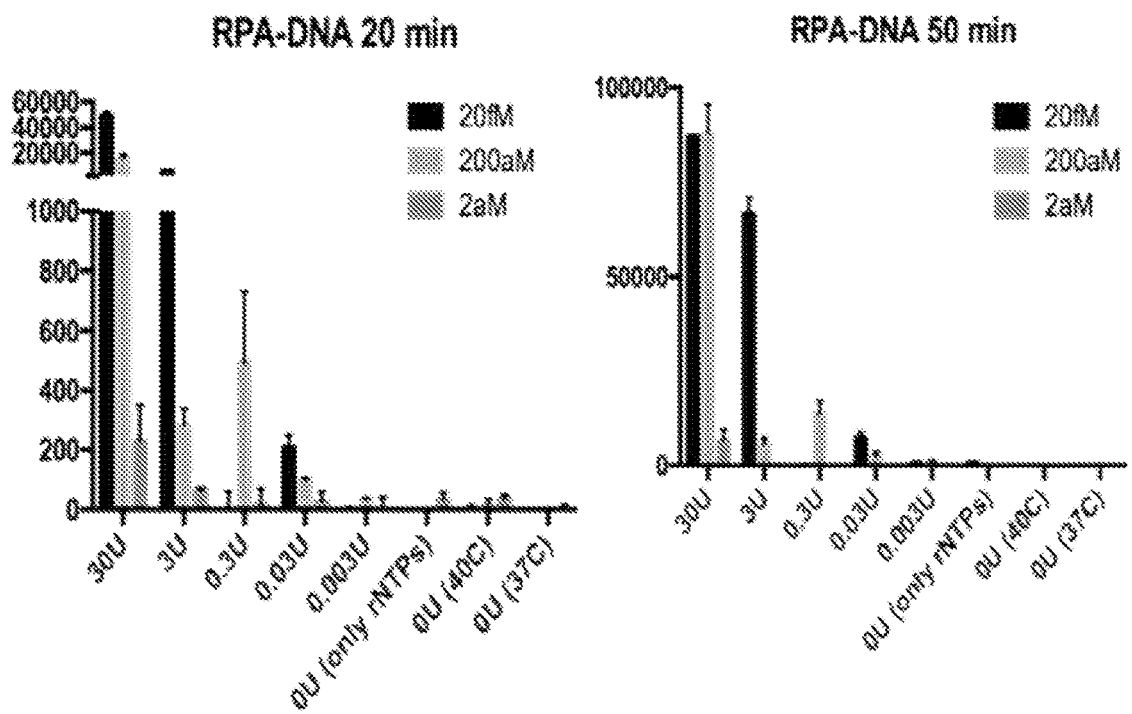
FIG. 20—provides a set of graphs demonstrating that mixing T7 polymerase into an RPA reaction does adversely affect DNA detection.
Figure 21:
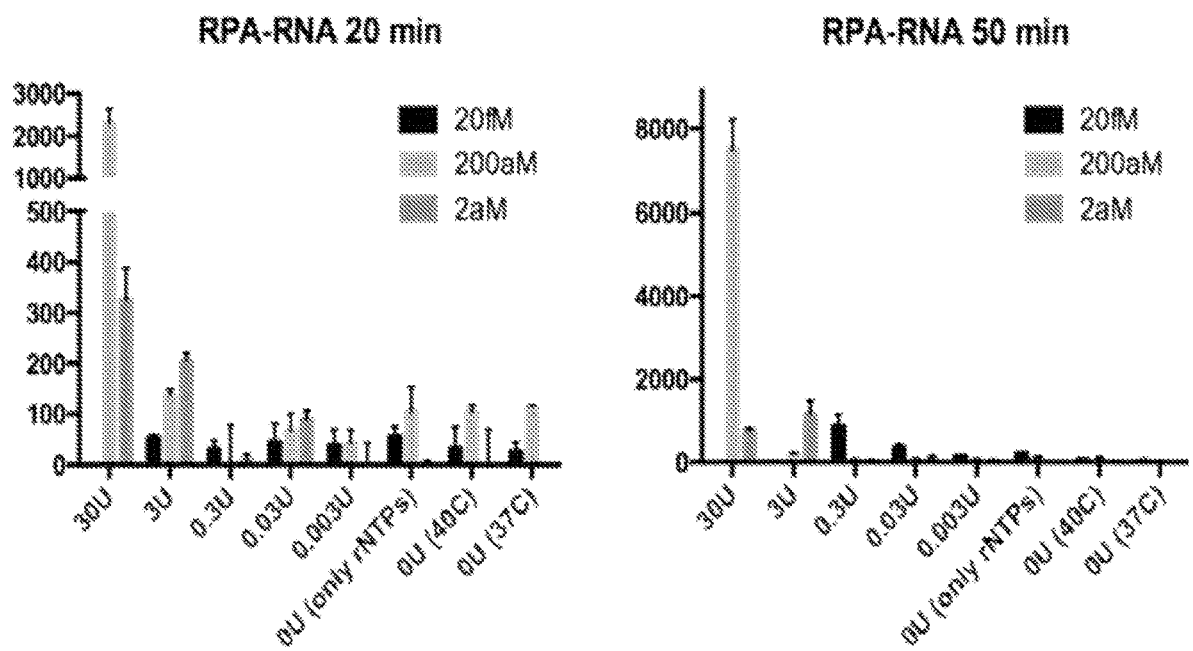
FIG. 21—provides a set of graphs demonstrating that mixing polymerase into an RPA reaction does not adversely affect DNA detection.

Real-time measurement of LwC2c2 RNase collateral activity was measured using a commercially available RNA fluorescent plate reader (FIG. 17A). To determine the baseline sensitivity of LwC2c2 activity, LwC2c2 was incubated with ssRNA target 1 (ssRNA 1) and a crRNA that is complementary to a site within the ssRNA target, along with the RNA sensor probe (FIG. 18). This yielded a sensitivity of ~50 fM (FIG. 27A), which, although more sensitive than other recent nucleic acid detection technologies (Pardee et al., 2014), is not sensitive enough for many diagnostic applications which require sub-femtomolar detection performance (Barletta et al., 2004; Emmadi et al., 2011; Rissin et al., 2010; Song et al., 2013).

To increase sensitivity, an isothermal amplification step was added prior to incubation with LwC2c2. Coupling LwC2c2-mediated detection with previously used isothermal amplification approaches such as nucleic acid sequence based amplification (NASBA)(Compton, 1991; Pardee et al., 2016) improved sensitivity to a certain extent (FIG. 11). An alternative isothermal amplification approach, recombinase polymerase amplification (RPA) (Piepenburg et al., 2006), was tested which can be used to amplify DNA exponentially in under two hours. By adding a T7 RNA polymerase promoter onto the RPA primers, amplified DNA can be converted to RNA for subsequent detection by LwC2c2 (FIG. 17). Thus, in certain example embodiments, the assay comprises the combination of amplification by RPA, T7 RNA polymerase conversion of DNA to RNA, and subsequent detection of the RNA by C2c2 unlocking of fluorescence from a quenched reporter.

Figure 22:
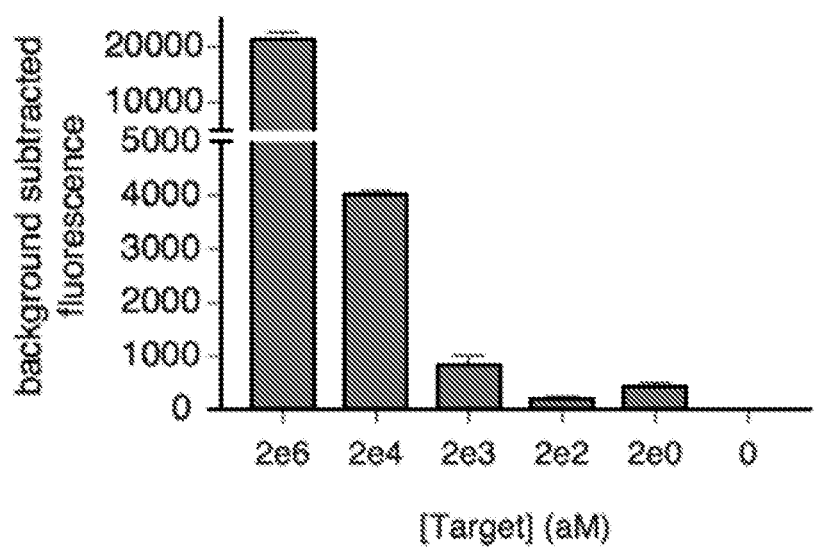
FIG. 22—provides a graph demonstrating that RPA, T7 transcription, and C2c2 detection reactions are compatible and achieve single molecule detection when incubated simultaneously (n=2 technical replicates; bars represent mean±s.e.m.).
Figure 23:
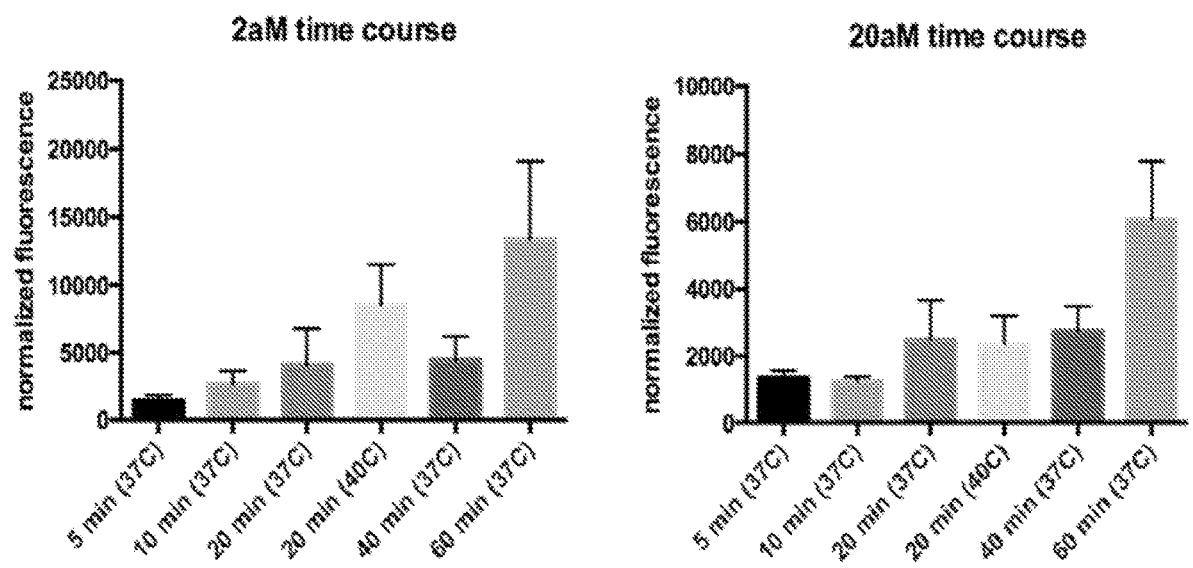
FIG. 23—provides a set of graphs demonstrating the efficacy of quick RPA-RNA time incubations.
Figure 24:
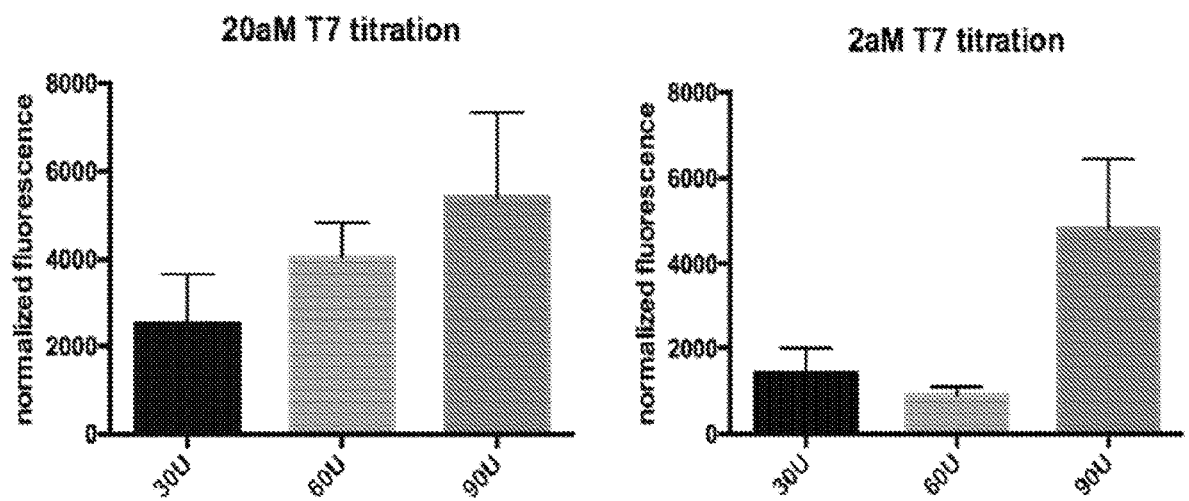
FIG. 24—provides a set of graphs demonstrating that increasing T7 polymerase amount boosts sensitivity for RPA-RNA.
Figure 25:
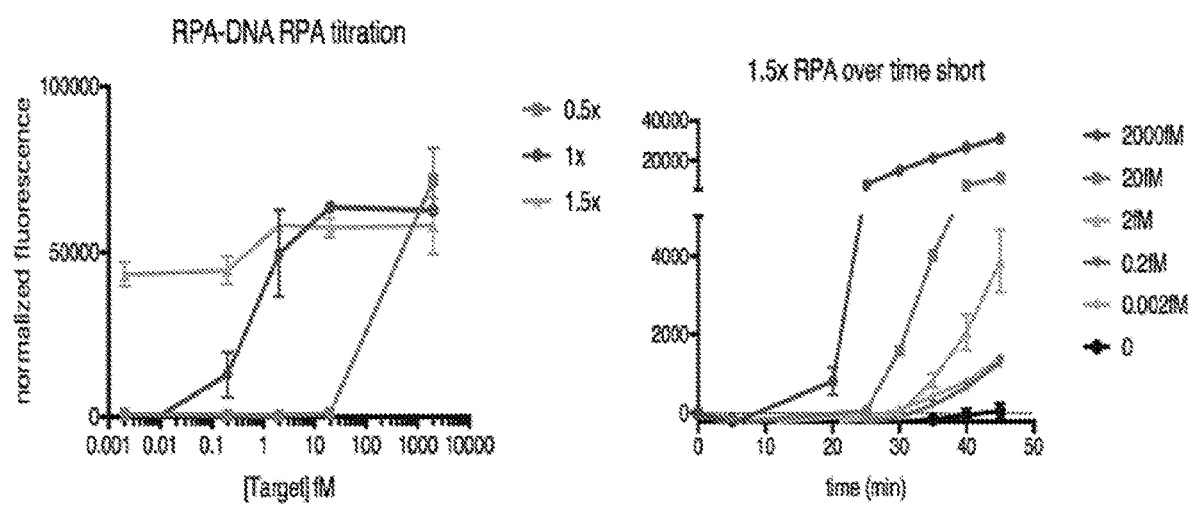
FIG. 25—provides a set of graphs showing results from an RPA-DNA detection assay using a one-pot reaction with 1.5× enzymes. Single molecule (2aM) detection achieved as early as 30 minutes.
Figure 26:
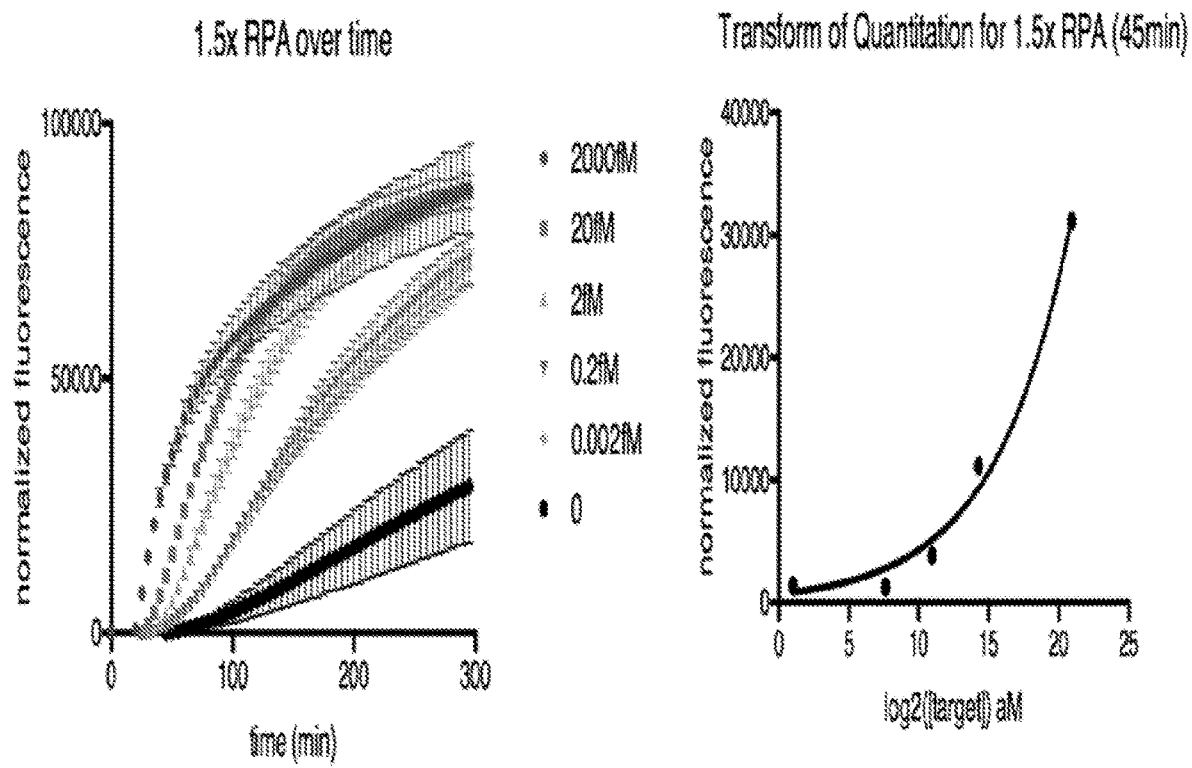
FIG. 26—provides a set of graphs demonstrating that an RPA-DNA one-pot reaction demonstrates a quantitative decrease in fluorescence relative to input concentration. The fitted curve reveals relationship between target input concentration and output fluorescence.

Using the example method on a synthesized DNA version of ssRNA 1, it was possible to achieve attomolar sensitivity in the range of 1-10 molecules per reaction (FIG. 27B, left). In order to verify the accuracy of detection, the concentration of input DNA was qualified with digital-droplet PCR and confirmed that the lowest detectable target concentration (2 aM) was at a concentration of a single molecule per microliter. With the addition of a reverse transcription step, RPA can also amplify RNA into a dsDNA form, allowing us attomolar sensitivity on ssRNA 1 to be achieved (27B, right). Similarly, the concentrations of RNA targets were confirmed by digital-droplet PCR. To evaluate the viability of the example method to function as a POC diagnostic test, the ability of all components—RPA, T7 polymerase amplification, and LwC2c2 detection—to function in a single reaction were tested and found attomolar sensitivity with a one-pot version of the assay (FIG. 22).

The Assay is Capable of Sensitive Viral Detection in Liquid or on Paper

Figure 33:
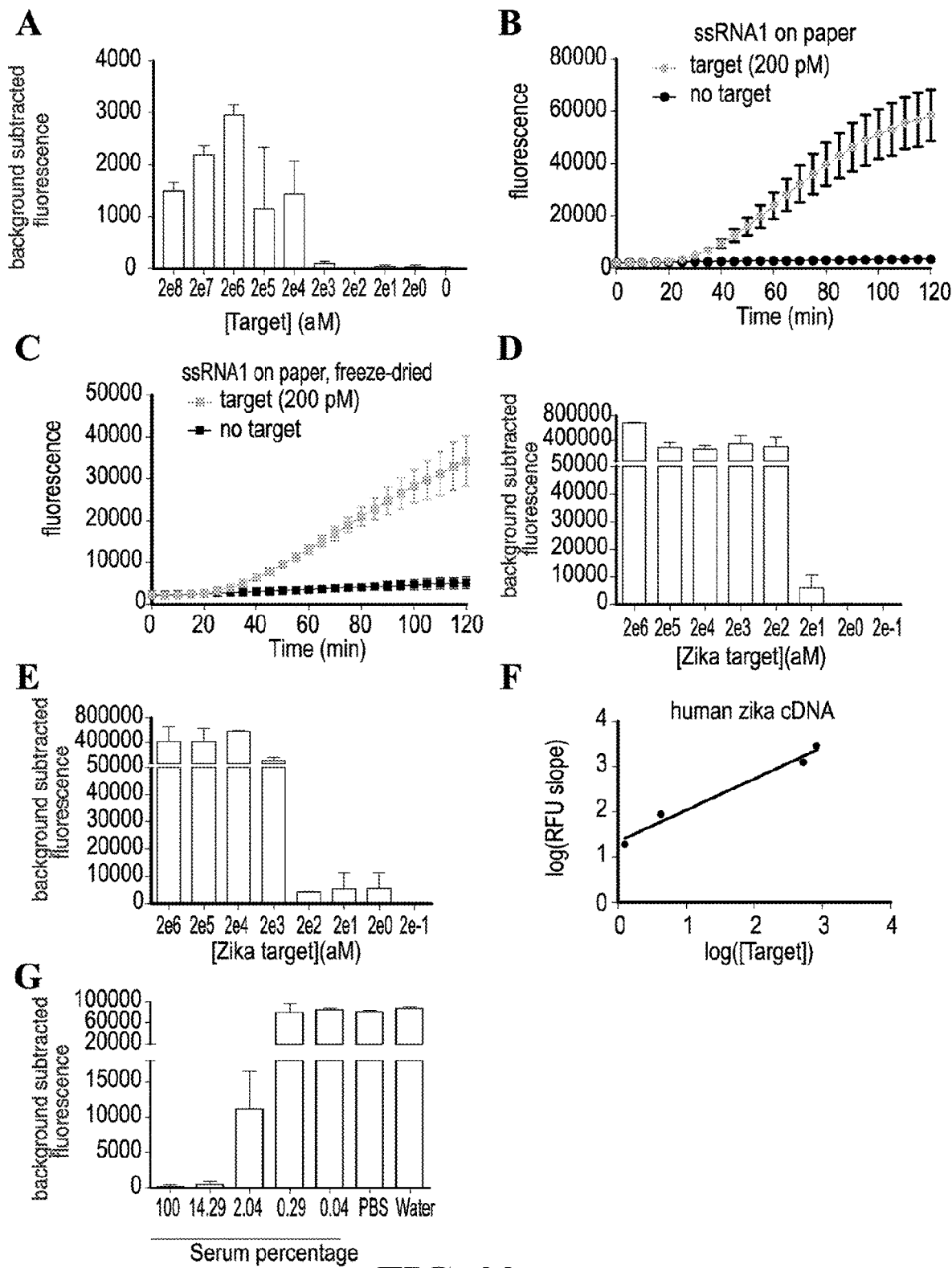
FIG. 33—provides a set of graphs demonstrating (A) freeze-dried C2c2 is capable of sensitive detection of ssRNA 1 in the low femtomolar range. C2c2 is capable of rapid detection of a 200 pM ssRNA 1 target on paper in liquid form (B) or freeze dried (C). The reaction is capable of sensitive detection of synthesized Zika RNA fragments in solution (D) (n=3) and in freeze-dried form (E) (n=3). (F) Quantitative curve for human Zika cDNA detection showing significant correlation between input concentration and detected fluorescence. (G) C2c2 detection of ssRNA 1 performed in the presence of varying amounts of human serum (n=2 technical replicates, unless otherwise noted; bars represent mean±s.e.m.).

It was next determined whether the assay would be effective in infectious disease applications that require high sensitivity and could benefit from a portable diagnostic. To test detection in a model system, lentiviruses harboring RNA fragments of the Zika virus genome and the related flavivirus Dengue (Dejnirattisai et al., 2016) were produced and the number of viral particles quantified (FIG. 31A). Levels of mock virus were detected down to 2 aM. At the same time, it was also possible to show clear discrimination between these proxy viruses containing Zika and Dengue RNA fragments (FIG. 31B). To determine whether the assay would be compatible with freeze-drying to remove dependence on cold chains for distribution, the reaction components were freeze-dried. After using the sample to rehydrate the lyophilized components, 20 fM of ssRNA 1 was detected (FIG. 33A). Because resource-poor and POC settings would benefit from a paper test for ease of usability, the activity of C2c2 detection on glass fiber paper was also evaluated and found that a paper-spotted C2c2 reaction was capable of target detection (FIG. 33B). In combination, freeze-drying and paper-spotting the C2c2 detection reaction resulted in sensitive detection of ssRNA 1 (FIG. 33C). Similar levels of sensitivity were also observed for detection of a synthetic Zika viral RNA fragment between LwC2c2 in solution and freeze-dried LwC2c2, demonstrating the robustness of freeze-dried SHERLOCK and the potential for a rapid, POC Zika virus diagnostic (FIG. 33D-E). Toward this end, the ability of the POC variant of the assay was tested to determine the ability to discriminate Zika RNA from Dengue RNA (FIG. 31C). While paper-spotting and lyophilization slightly reduced the absolute signal of the readout, the assay still significantly detected mock Zika virus at concentrations as low as 20 aM (FIG. 31D), compared to detection of mock virus with the Dengue control sequence.

Zika viral RNA levels in humans have been reported to be as low as $3 \times 10^6$ copies/mL (4.9 fM) in patient saliva and $7.2 \times 10^5$ copies/mL (1.2 fM) in patient serum (Barzon et al., 2016; Gourinat et al., 2015; Lanciotti et al., 2008). From obtained patient samples, concentrations as low as $1.25 \times 10^3$ copies/mL (2.1 aM) were observed. To evaluate whether the assay is capable of Zika virus detection of low-titer clinical isolates, viral RNA was extracted from patients and reverse transcribed and the resulting cDNA was used as input for the assay (FIG. 32A). Significant detection for the Zika human serum samples was observed at concentrations down to 1.25 copy/uL (2.1 aM) (FIG. 32B). Furthermore, signal from patient samples was predictive of Zika viral RNA copy number and could be used to predict viral load (FIG. 31F). To test broad applicability for disease situations where nucleic acid purification is unavailable, detection of ssRNA 1 spiked into human serum was tested, and it was determined that the assay was activated at serum levels below 2% (FIG. 33G).

Bacterial Pathogen Distinction and Gene Distinction

Figure 34:
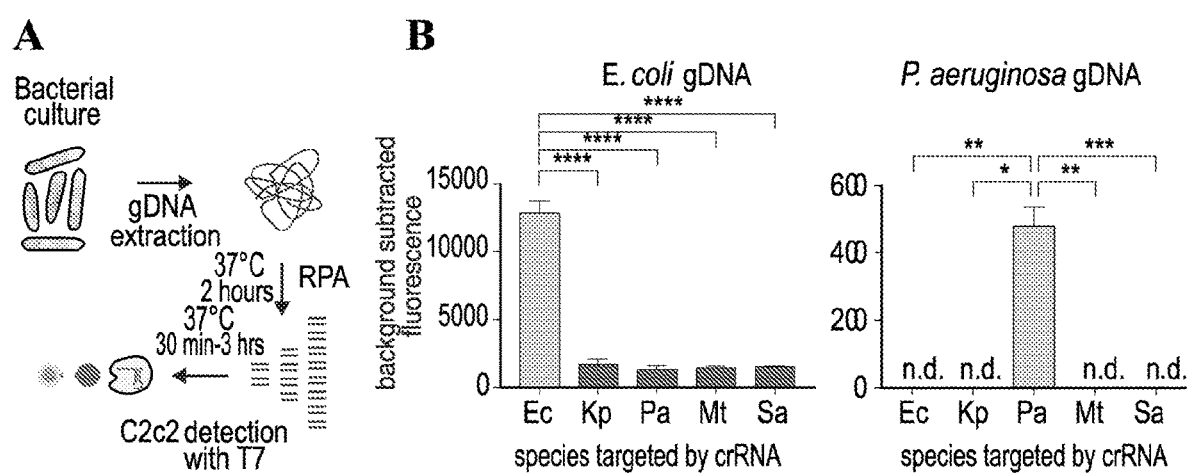
FIG. 34—provides (A) schematic of C2c2 detection of 16S rRNA gene from bacterial genomes using a universal V3 RPA primer set, and (B) the ability to achieve sensitive and specific detection of *E. coli* or *P. aeruginosa* gDNA using an assay conducted in accordance with certain example embodiments (n=4 technical replicates, two-tailed Student t-test; ****, p<0.0001; bars represent mean±s.e.m.). Ec, *Escherichia coli*; Kp, *Klebsiella pneumoniae*; Pa, *Pseudomonas aeruginosa*; Mt, *Mycobacterium tuberculosis*; Sa, *Staphylococcus aureus*.

To determine if the assay could be used to distinguish bacterial pathogens, the 16S V3 region was selected as an initial target, as the conserved flanking regions allow universal RPA primers to be used across bacterial species, and the variable internal region allowing for differentiation of species. A panel of 5 possible targeting crRNAs were designed for pathogenic strains and isolated *E. coli* and *Pseudomonas aeruginosa* gDNA (FIG. 34A). The assay was capable of distinguishing *E. coli* or *P. aeruginosa* gDNA and showed low background signal for crRNAs of other species (FIG. 34 A, B).

Figure 35:
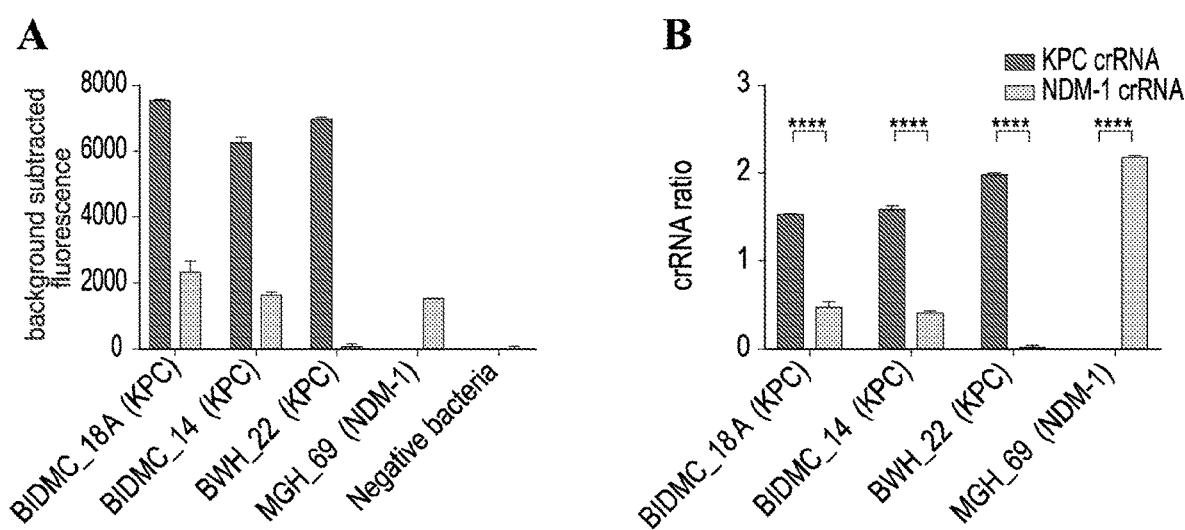

The assay can also be adapted to rapidly detect and distinguish bacterial genes of interest, such as antibiotic-resistance genes. Carbapenem-resistant enterobacteria (CRE) are a significant emerging public health challenge (Gupta et al., 2011). The ability of the assay to detect carbapenem-resistance genes was evaluated, and if the test could distinguish between different carbapenem-resistance genes. *Klebsiella pneumonia* was obtained from clinical isolates harboring either *Klebsiella pneumoniae* carbapenemase (KPC) or New Delhi metallo-beta-lactamase 1 (NDM-1) resistance genes and designed crRNAs to distinguish between the genes. All CRE had significant signal over bacteria lacking these resistance genes (FIG. 35A) and that we could significantly distinguish between KPC and NDM-1 strains of resistance (FIG. 35B).

Single-Base Mismatch Specificity of CRISPR RNA-Guided RNases

It has been shown that certain CRISPR RNA-guided RNase orthologues, such as LshC2c2, do not readily distinguish single-base mismatches. (Abudayyeh et al., 2016). As demonstrated herein, LwC2c2 also shares this feature (FIG. 37A). To increase the specificity of LwC2c2 cleavage, a system for introducing synthetic mismatches in the crRNA: target duplex was developed that increases the total sensitivity to mismatches and enables single-base mismatch sensitivity. Multiple crRNAs for target 1 were designed and included mismatches across the length of the crRNA (FIG. 37A) to optimize on-target cleavage and minimize cleavage of a target that differs by a single mismatch. These mismatches did not reduce cleavage efficiency of ssRNA target 1, but significantly decreased signal for a target that included an additional mismatch (ssRNA target 2). The designed crRNA that best distinguished between targets 1 and 2 included synthetic mismatches close to the target 2 mismatch, in effect creating a "bubble." The loss of sensitivity caused by the coordination of a synthetic mismatch and an additional mismatch present in the target (i.e., a double mismatch) agrees with the sensitivity of LshC2c2 to consecutive or nearby double mismatches (Abudayyeh et al., 2016) and presents a format for rational design of crRNAs that enable single-nucleotide distinction (FIG. 37B).

Having demonstrated that C2c2 can be engineered to recognize single-base mismatches, it was determined whether this engineered specificity could be used to distinguish between closely related viral pathogens. Multiple crRNAs were designed to detect either the African or American strains of Zika virus (FIG. 37A) and either strain 1 or 3 of Dengue virus (FIG. 37C). These crRNAs included a synthetic mismatch in the spacer sequence, causing a single bubble to form when duplexed to the on-target strain due to the synthetic mismatch. However, when the synthetic mismatch spacer is duplexed to the off-target strain two bubbles form due to the synthetic mismatch and the SNP mismatch. The synthetic mismatch crRNAs detected their corresponding strains with significantly higher signal than the off-target strain allowing for robust strain distinction (FIG. 37B, 37D). Due to the significant sequence similarity between strains, it was not possible to find a continuous stretch of 28 nt with only a single nucleotide difference between the two genomes in order to demonstrate true single-nucleotide strain distinction. However, it was predicted that shorter crRNAs would still be functional, as they are with LshC2c2 (Abudayyeh et al., 2016), and accordingly shorter 23-nt crRNAs were designed against targets in the two Zika strains that included a synthetic mismatch in the spacer sequence and only one mismatch in the target sequence. These crRNAs were still capable of distinguishing the African and American strains of Zika with high sensitivity (FIG. 36C).

Rapid Genotyping Using DNA Purified from Saliva

Rapid genotyping from human saliva could be useful in emergency pharmacogenomic situations or for at-home diagnostics. To demonstrate the potential of the embodiments disclosed herein for genotyping, five loci were chosen to benchmark C2c2 detection using 23andMe genotyping data as the gold standard (Eriksson et al., 2010) (FIG. 38A). The five loci span a broad range of functional associations, including sensitivity to drugs, such as statins or acetaminophen, norovirus susceptibility, and risk of heart disease (Table 12).

TABLE 12

| SNP Variants tested | | |
|---|---|---|
| ID | Gene | Category |
| rs5082 | APOA2 | Saturated fat consumption and weight gain |
| rs1467558 | CD44 | Acetaminophen metabolism |
| rs2952768 | near CREB1 | morphine dependence |
| rs4363657 | SLCO1B1 | 4.5x increase myopathy risk for statin users |
| rs601338 | FUT2 | resistance to norovirus |

Saliva from four human subjects was collected and the genomic DNA purified using a simple commercial kit in less than an hour. The four subjects had a diverse set of genotypes across the five loci, providing a wide enough sample space for which to benchmark the assay for genotyping. For each of the five SNP loci, a subject's genomic DNA was amplified using RPA with the appropriate primers followed by detection with LwC2c2 and pairs of crRNAs designed to specifically detect one of the two possible alleles (FIG. 38B). The assay was specific enough to distinguish alleles with high significance and to infer both homozygous and heterozygous genotypes. Because a DNA extraction protocol was performed on the saliva prior to detection, the assay was tested to determine if it could be made even more amenable for POC genotyping by using saliva heated to 95° C. for 5 minutes without any further extraction. The assay was capable of correctly genotyping two patients whose saliva was only subjected to heating for 5 minutes and then subsequent amplification and C2c2 detection (FIG. 40B).

Detection of Cancerous Mutations in cfDNA at Low-Allelic Fractions

Because the assay is highly specific to single nucleotide differences in targets, a test was devised to determine if the assay was sensitive enough to detect cancer mutations in cell-free DNA (cfDNA). cfDNA fragments are small percentage (0.1% to 5%) of wild-type cfDNA fragments (Bettegowda et al., 2014; Newman et al., 2014; Olmedillas Lopez et al., 2016; Qin et al., 2016). A significant challenge in the cfDNA field is detecting these mutations because they are typically difficult to discover given the high levels of non-mutated DNA found in the background in blood (Bettegowda et al., 2014; Newman et al., 2014; Qin et al., 2016). A POC cfDNA cancer test would also be useful for regular screening of cancer presence, especially for patients at risk for remission.

The assay's ability to detect mutant DNA in wild-type background was determined by diluting dsDNA target 1 in a background of ssDNA1 with a single mutation in the crRNA target site (FIG. 41A-B). LwC2c2 was capable of sensing dsDNA 1 to levels as low as 0.1% of the background dsDNA and within attomolar concentrations of dsDNA 1. This result shows that LwC2c2 cleavage of background mutant dsDNA 1 is low enough to allow robust detection of the on-target dsDNA at 0.1% allelic fraction. At levels lower than 0.1%, background activity is likely an issue, preventing any further significant detection of the correct target.

Because the assay could sense synthetic targets with allelic fractions in a clinically relevant range, it was evaluated whether the assay was capable of detecting cancer mutations in cfDNA. RPA primers to two different cancer mutations, EGFR L858R and BRAF V600E, were designed and commercial cfDNA standards were used with allelic fractions of 5%, 1%, and 0.1% that resemble actual human cfDNA samples to test. Using a pair of crRNAs that could distinguish the mutant allele from the wild-type allele (FIG.

38C), detection of the 0.1% allelic fraction for both of the mutant loci was achieved (FIG. 39 A-B).

Discussion

By combining the natural properties of C2c2 with isothermal amplification and a quenched fluorescent probe, the assay and systems disclosed herein have been demonstrated as a versatile, robust method to detect RNA and DNA, and suitable for a variety of rapid diagnoses including infectious disease applications and rapid genotyping. A major advantage of the assays and systems disclosed herein is that a new POC test can be redesigned and synthesized in a matter of days for as low as $0.6/test.

Because many human disease applications require the ability to detect single mismatches a rational approach was developed to engineer crRNAs to be highly specific to a single mismatch in the target sequence by introducing a synthetic mismatch in the spacer sequence of the crRNA. Other approaches for achieving specificity with CRISPR effectors rely on screening-based methods over dozens of guide designs (Chavez et al., 2016). Using designed mismatch crRNAs, discrimination of Zika and Dengue viral strains in sites that differ by a single mismatch, rapid genotyping of SNPs from human saliva gDNA, and detection of cancer mutations in cfDNA samples, was demonstrated.

The low cost and adaptability of the assay platform lends itself to further applications including (i) general RNA/DNA quantitation experience in substitute of specific qPCR assays, such as Taqman, (ii) rapid, multiplexed RNA expression detection resembling microarrays, and (iii) other sensitive detection applications, such as detection of nucleic acid contamination from other sources in food. Additionally, C2c2 could potentially be used for detection of transcripts within biological settings, such as in cells, and given the highly specific nature of C2c2 detection, it may be possible to track allelic specific expression of transcripts or disease-associated mutations in live cells. With the wide availability of aptamers, it might also be possible to sense proteins by coupling the detection of protein by an aptamer to the revealing of a cryptic amplification site for RPA followed by C2c2 detection.

Nucleic Acid Detection with CRISPR-Cas13a/C2c2: Attomolar Sensitivity and Single Nucleotide Specificity To achieve robust signal detection, we identified an ortholog of Cas13a from *Leptotrichia wadei* (LwCas13a), which displays greater RNA-guided RNase activity relative to *Leptotrichia shahii* Cas13a (LshCas13a) (10) (FIG. 2, see also above "Characterization of LwCas13a cleavage requirements"). LwCas13a incubated with ssRNA target 1 (ssRNA 1), crRNA, and reporter (quenched fluorescent RNA) (FIG. 18) (13) yielded a detection sensitivity of ~50 fM (FIG. 51, 15), which is not sensitive enough for many diagnostic applications (12, 14-16). We therefore explored combining Cas13a-based detection with different isothermal amplification steps (FIG. 10, 11, 53, 16) (17, 18). Of the methods explored, recombinase polymerase amplification (RPA) (18) afforded the greatest sensitivity and can be coupled with T7 transcription to convert amplified DNA to RNA for subsequent detection by LwCas13a (see also above "Discussion of Recombinase Polymerase Amplification (RPA) and other isothermal amplification strategies."). We refer to this combination of amplification by RPA, T7 RNA polymerase transcription of amplified DNA to RNA, and detection of target RNA by Cas13a collateral RNA cleavage-mediated release of reporter signal as SHERLOCK.

Figure 27:
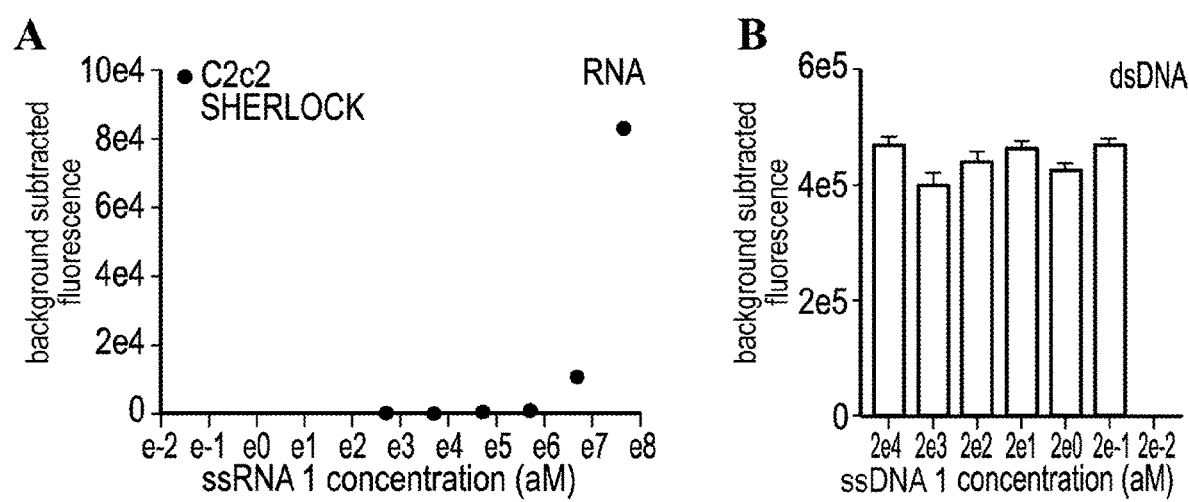
FIG. 27—provides a set of graphs demonstrating that (A) C2c2 detection of RNA without amplification can detect ssRNA target at concentrations down to 50 fM (n=2 technical replicates; bars represent mean±s.e.m.), and that (B) the RPA-C2c2 reaction is capable of single-molecule DNA detection (n=4 technical replicates; bars represent mean±s.e.m.).
Figure 28:
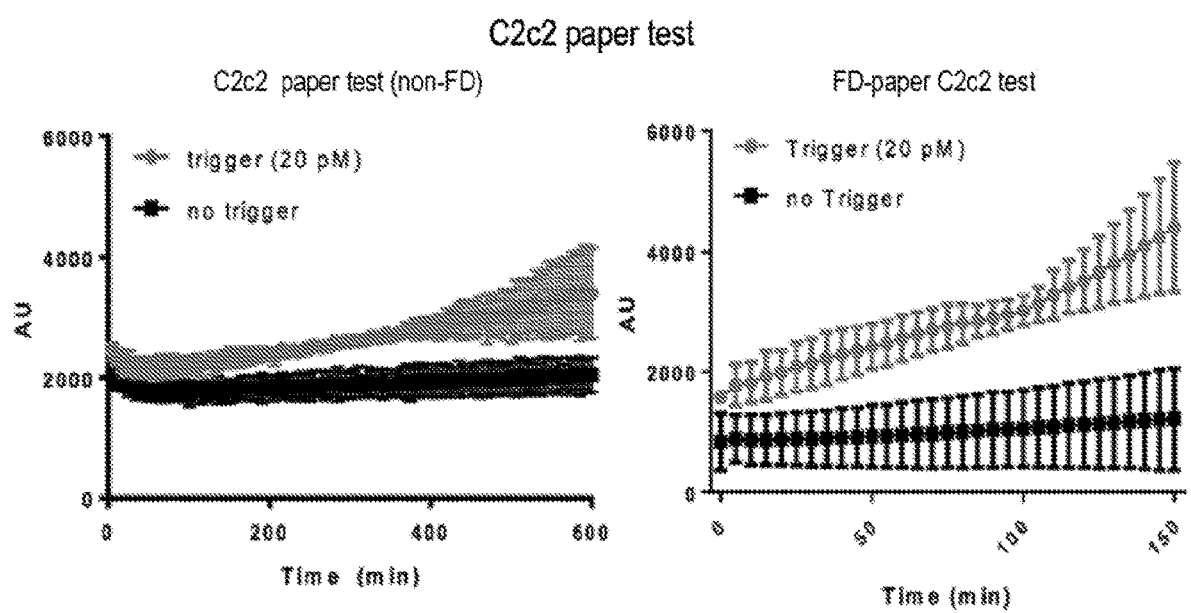
FIG. 28—provides a set of graphs demonstrating that a C2c2 signal generated in accordance with certain example embodiments can detect a 20 pM target on a paper substrate.
Figure 29:
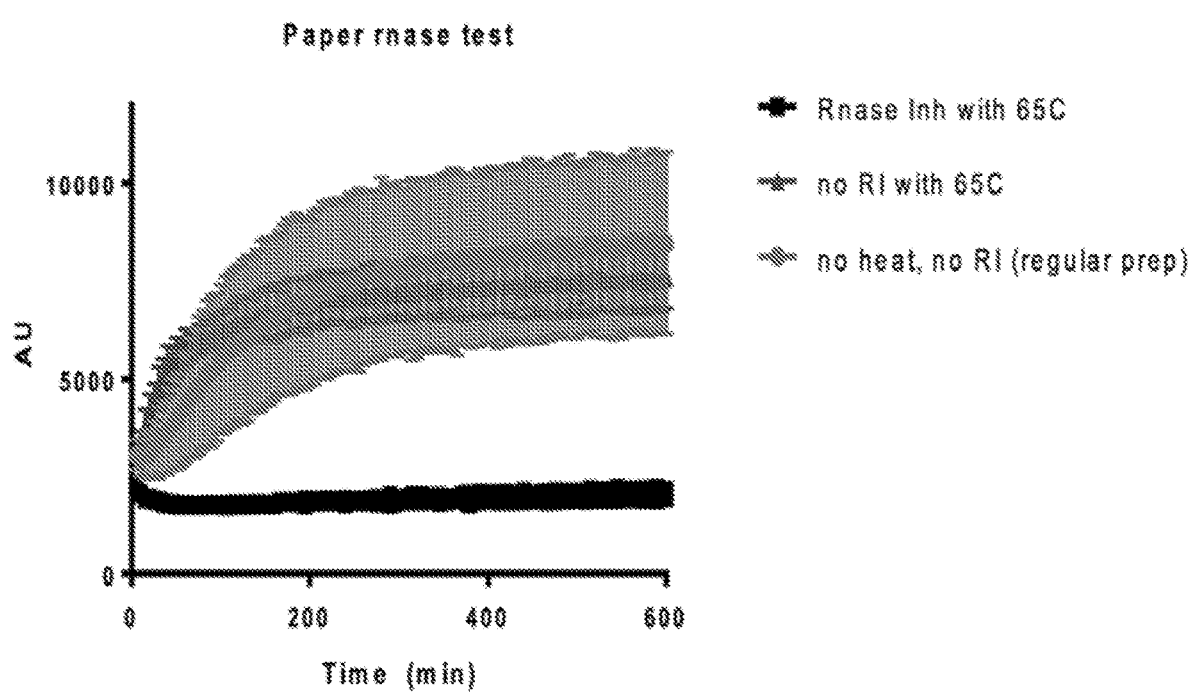
FIG. 29—provides a graph showing that a specific RNAse inhibitor is capable of removing background signal on paper.
Figure 30:
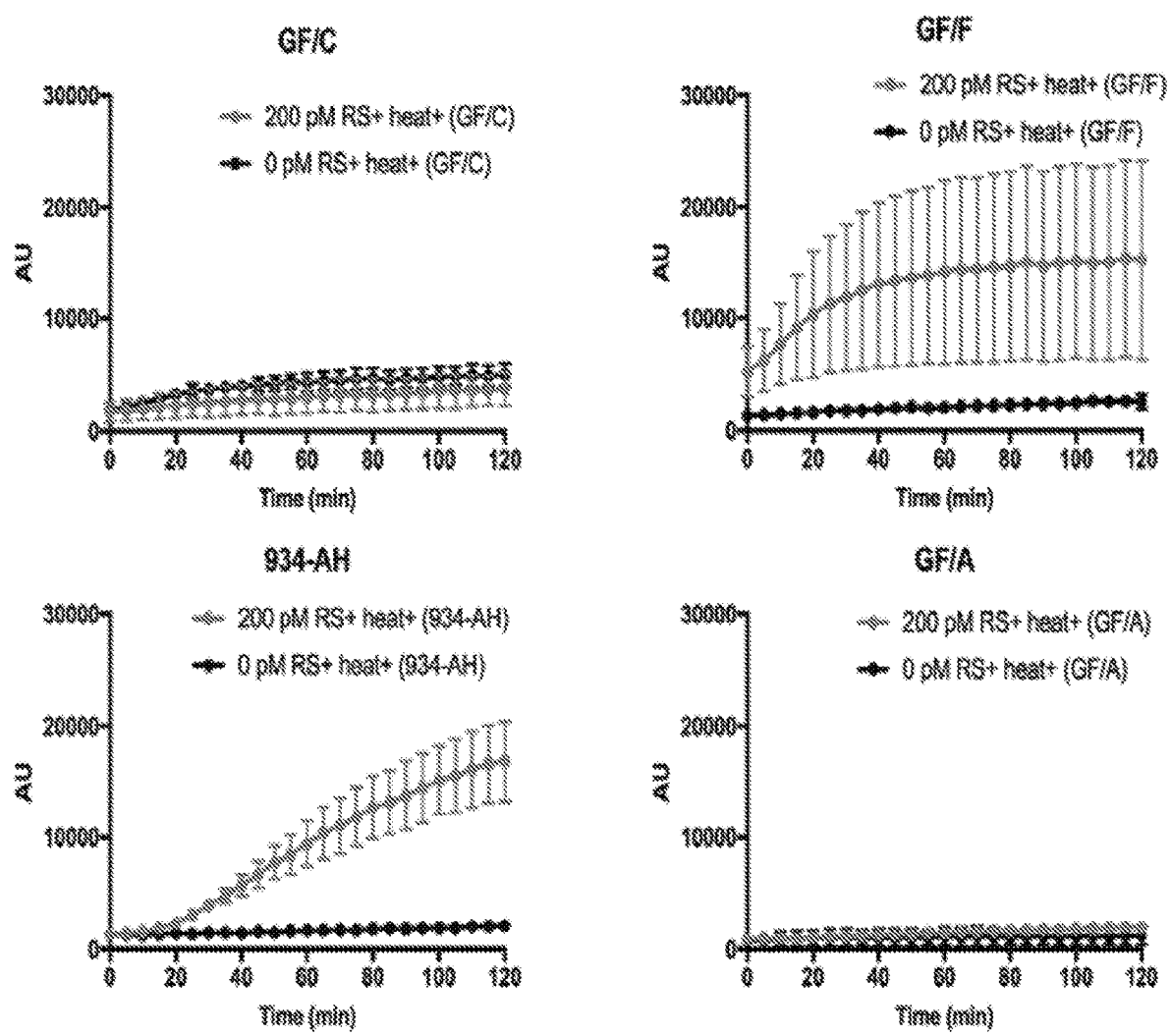
FIG. 30 is a set of graphs showing detection using systems in accordance with certain example embodiments on glass fiber substrates.

We first determined the sensitivity of SHERLOCK for detection of RNA (when coupled with reverse transcription) or DNA targets. We achieved single molecule sensitivity for both RNA and DNA, as verified by digital-droplet PCR (ddPCR) (FIG. 27, 51, 54A,B). Attomolar sensitivity was maintained when we combined all SHERLOCK components in a single reaction, demonstrating the viability of this platform as a point-of-care (POC) diagnostic (FIG. 54C). SHERLOCK has similar levels of sensitivity as ddPCR and quantitative PCR (qPCR), two established sensitive nucleic acid detection approaches, whereas RPA alone was not sensitive enough to detect low levels of target (FIG. 55A-D). Moreover, SHERLOCK shows less variation than ddPCR, qPCR, and RPA, as measured by the coefficient of variation across replicates (FIG. 55E-F).

We next examined whether SHERLOCK would be effective in infectious disease applications that require high sensitivity. We produced lentiviruses harboring genome fragments of either Zika virus (ZIKV) or the related flavivirus Dengue (DENV) (19) (FIG. 31A). SHERLOCK detected viral particles down to 2 aM and could discriminate between ZIKV and DENV (FIG. 31B). To explore the potential use of SHERLOCK in the field, we first demonstrated that Cas13acrRNA complexes lyophilized and subsequently rehydrated (20) could detect 20 fM of nonamplified ssRNA 1 (FIG. 33A) and that target detection was also possible on glass fiber paper (FIG. 33B). The other components of SHERLOCK are also amenable to freeze-drying: RPA is provided as a lyophilized reagent at ambient temperature, and we previously demonstrated that T7 polymerase tolerates freeze-drying (2). In combination, freeze-drying and paper-spotting the Cas13a detection reaction resulted in comparable levels of sensitive detection of ssRNA 1 as aqueous reactions (FIG. 33C-E). Although paper-spotting and lyophilization slightly reduced the absolute signal of the readout, SHERLOCK (FIG. 31C) could readily detect mock ZIKV virus at concentrations as low as 20 aM (FIG. 31D). SHERLOCK is also able to detect ZIKV in clinical isolates (serum, urine, or saliva) where titers can be as low as 2×10$^3$ copies/mL (3.2 aM) (21). ZIKV RNA extracted from patient serum or urine samples and reverse transcribed into cDNA (FIGS. 32E and 52A) could be detected at concentrations down to 1.25×10$^3$ copies/mL (2.1 aM), as verified by qPCR (FIGS. 32F and 52B). Furthermore, the signal from patient samples was predictive of ZIKV RNA copy number and could be used to predict viral load (FIG. 33F). To simulate sample detection without nucleic acid purification, we measured detection of ssRNA 1 spiked into human serum, and found that Cas13a could detect RNA in reactions containing as much as 2% serum (FIG. 33G). Another important epidemiological application for CRISPR-dx is the identification of bacterial pathogens and detection of specific bacterial genes. We targeted the 16S rRNA gene V3 region, where conserved flanking regions allow universal RPA primers to be used across bacterial species and the variable internal region allows for differentiation of species. In a panel of five possible targeting crRNAs for different pathogenic strains and gDNA isolated from *E. coli* and *Pseudomonas aeruginosa* (FIG. 34A), SHERLOCK correctly genotyped strains and showed low cross-reactivity (FIG. 34B). Additionally, we were able to use SHERLOCK to distinguish between clinical isolates of *Klebsiella pneumoniae* with two different resistance genes: *Klebsiella pneumoniae* carbapenemase (KPC) and New Delhi metallo-beta-lactamase 1 (NDM-1) (22) (FIG. 56).

To increase the specificity of SHERLOCK, we introduced synthetic mismatches in the crRNA:target duplex that enable LwCas13a to discriminate between targets that differ by a single-base mismatch (FIG. 36A,B; see also above "Design of engineered mismatches"). We designed multiple crRNAs with synthetic mismatches in the spacer sequences to detect either the African or American strains of ZIKV (FIG. 37A) and strain 1 or 3 of DENV (FIG. 37C). Synthetic mismatch crRNAs detected their corresponding strains with significantly higher signal (two-tailed Student t-test; p<0.01) than the off-target strain, allowing for robust strain discrimination based off single mismatches (FIG. 37B, D, 36C). Further characterization revealed that Cas13a detection achieves maximal specificity while maintaining on-target sensitivity when a mutation is in position 3 of the spacer and the synthetic mismatch is in position 5 (FIGS. 57 and 58). The ability to detect single-base differences opens the opportunity of using SHERLOCK for rapid human genotyping. We chose five loci spanning a range of health-related single-nucleotide polymorphisms (SNPs) (Table 1) and benchmarked SHERLOCK detection using 23andMe genotyping data as the gold standard at these SNPs (23) (FIG. 38A). We collected saliva from four human subjects with diverse genotypes across the loci of interest, and extracted genomic DNA either through commercial column purification or direct heating for five minutes (20). SHERLOCK distinguished alleles with high significance and with enough specificity to infer both homozygous and heterozygous genotypes (FIG. 38B, 40, 59, 60; see also above "Genotyping with SHERLOCK using synthetic standards"). Finally, we sought to determine if SHERLOCK could detect low frequency cancer mutations in cell free (cf) DNA fragments, which is challenging because of the high levels of wild-type DNA in patient blood (24-26). We first found that SHERLOCK could detect ssDNA 1 at attomolar concentrations diluted in a background of genomic DNA (FIG. 61). Next, we found that SHERLOCK was also able to detect single nucleotide polymorphism (SNP)-containing alleles (FIG. 41A,B) at levels as low as 0.1% of background DNA, which is in the clinically relevant range. We then demonstrated that SHERLOCK could detect two different cancer mutations, EGFR L858R and BRAF V600E, in mock cfDNA samples with allelic fractions as low as 0.1% (FIG. 38, 39) (20).

The SHERLOCK platform lends itself to further applications including (i) general RNA/DNA quantitation in lieu of specific qPCR assays, such as TaqMan, (ii) rapid, multiplexed RNA expression detection, and (iii) other sensitive detection applications, such as detection of nucleic acid contamination. Additionally, Cas13a could potentially detect transcripts within biological settings and track allele-specific expression of transcripts or disease-associated mutations in live cells. We have shown that SHERLOCK is a versatile, robust method to detect RNA and DNA, suitable for rapid diagnoses including infectious disease applications and sensitive genotyping. A SHERLOCK paper test can be redesigned and synthesized in a matter of days for as low as $0.61/test (see also above "SHERLOCK is an affordable, adaptable CRISPR-Dx platform") with confidence, as almost every crRNA tested resulted in high sensitivity and specificity. These qualities highlight the power of CRISPR-Dx and open new avenues for rapid, robust and sensitive detection of biological molecules.

TABLE 13

RPA Primers used

| Name | Sequence | 1st FIG. |
|---|---|---|
| RP0683 - RPA ssDNA/ssRNA 1 F | AATTCTAATACGACTCACTATAGGGATCCTCTAGAA ATATGGATTACTTGGTAGAACAG (SEQ. I.D. No. 18) | FIG. 27B |
| RP0684 - RPA ssDNA/ssRNA 1 R | GATAAACACAGGAAACAGCTATGACCATGATTACG (SEQ. I.D. No. 19) | FIG. 27B |
| AMPL-25 Zika 8B long-rpa3-f | AAT TCT AAT ACG ACT CAC TAT AGGCCGCTGCTAATGATAGGTTGCTACTCACAA (SEQ. I.D. No. 20) | FIG. 31B |
| AMPL-26 Zika 8B long-rpa3-r | TCAATGTCAGTCACCACTATTCCATCCACAACAG (SEQ. I.D. No. 21) | FIG. 31B |
| RP819 - zika region 8 F | gaaatTAATACGACTCACTATAGGGCGTGGCGCACTAC ATGTACT (SEQ. I.D. No. 22) | FIG. 31C |
| RP821 - zika region 8 R | TGTCAATGTCAGTCACCACTATTCCATCCA (SEQ. I.D. No. 23) | FIG. 31C |
| 517 bacterial V3 F | AATTCTAATACGACTCACTATAGGGtccaGACTCCTAC GGGAGGCWGCA (SEQ. I.D. No. 24) | FIG. 34B |
| RP758 bacterial V3 R | TTTCGCTCTATTCTCATCAGTTTCATGTCCTGTGTCA TTACCGCGGCTGCTG (SEQ. I.D. No. 25) | FIG. 34B |
| wR0074 A2 rs5082 F | GGTACACTTCAGGTATATTTGAGGTTCATTC (SEQ. I.D. No. 26) | FIG. 38B |
| wR0074 E2 rs5082 R | gaaattaatacgactcactatagggGTTGATATGTCAGAGCTTTCC AGAGAAATAA (SEQ. I.D. No. 27) | FIG. 38B |
| wR0074 A4 rs1467558 F | ACACTAATATTGATTCCTTCAGATATGGACT (SEQ. I.D. No. 28) | FIG. 38B |
| wR0074 E4 rs1467558 R | gaaattaatacgactcactatagggATCGTTATTCTTACGCGTTGT CATTGAAAG (SEQ. I.D. No. 29) | FIG. 38B |

TABLE 13-continued

RPA Primers used

| Name | Sequence | 1st FIG. |
|---|---|---|
| wR0074 A5 rs2952768 F | GAATCTCTTGAACCCAGTAGGCAGAGGTTG (SEQ. I.D. No. 30) | FIG. 38B |
| wR0074 E5 rs2952768 R | gaaattaatacgactcactatagggAAAGGCCTAAGTGTCCTTCTACCATTATTTTG (SEQ. I.D. No. 31) | FIG. 38B |
| wR0074 A9 rs4363657 F | TTTGTTTTTGATGTTGTTGTTGTTTTTGTGTC (SEQ. I.D. No. 32) | FIG. 38B |
| wR0074 E9 rs4363657 R | gaaattaatacgactcactatagggAATGCATTCATAGCCAAATTCTACTGGAAATA (SEQ. I.D. No. 33) | FIG. 38B |
| wR0074 A11 rs601338 F | GAGTACGTCCGCTTCACCGGCTACCCCTGCTC (SEQ. I.D. No. 34) | FIG. 38B |
| wR0074 E11 rs601338 R | gaaattaatacgactcactatagggATAGTCCCCTCGGCGAACATGGACCCCTACAA (SEQ. I.D. No. 35) | FIG. 38B |
| RP824 BRAFV600E cfDNA F | gaaatTAATACGACTCACTATAGGGTCATGAAGACCTCACAGTAAAAATAGGTGATT (SEQ. I.D. No. 36) | FIG. 39A |
| RP769 BRAFV600E cfDNA R | ATTCTTACCATCCACAAAATGGATCCAGACAA (SEQ. I.D. No. 37) | FIG. 39A |
| RP826 EGFR858R cfDNA F | gaaatTAATACGACTCACTATAGGGGCAGCATGTCAAGATCACAGATTTTGGG (SEQ. I.D. No. 38) | FIG. 39B |
| RP804 EGFR858R cfDNA R | CCTCCTTCTGCATGGTATTCTTTCTCTTC (SEQ. I.D. No. 39) | FIG. 39B |
| AMPL-31 T1-nasba1-f | AAT CTA AAT ACG ACT CAC TAT AGGGGGATCCTCTAGAAATATGGATT (SEQ. I.D. No. 40) | FIG. 11 |
| AMPL-32 T1-nasba1-r | CTCGTATGTTGTGTGGAATTGT (SEQ. I.D. No. 41) | FIG. 11 |
| AMPL-33 T1-nasba2-f | AAT CTA AAT ACG ACT CAC TAT AGGGGGATCCTCTAGAAATATGGATTAC (SEQ. I.D. No. 42) | FIG. 11 |
| AMPL-34 T1-nasb a2-r | AAACACAGGAAACAGCTATGAC (SEQ. I.D. No. 43) | FIG. 11 |
| AMPL-35 T1-nasba3-f | AAT CTA AAT ACG ACT CAC TAT AGGCCTCTAGAAATATGGATTACTTGGT (SEQ. I.D. No. 44) | FIG. 11 |
| AMPL-36 T1-nasba3-r | CGTATGTTGTGTGGAATTGTGA (SEQ. I.D. No. 45) | FIG. 11 |
| wR0075 A1 KPC F | gaaattaatacgactcactatagggCTGTCTTGTCTCTCATGGCCGCTGGCTGGCTTTTC (SEQ. I.D. No. 46) | FIG. 35A |
| wR0075 B1 KPC R | CGTACACACCGATGGAGCCGCCAAAGTCCTGTT (SEQ. I.D. No. 47) | FIG. 35A |
| wR0075 A3 NDM F | gaaattaatacgactcactatagggAGCAAATGGAAACTGGCGACCAACGGTTTGGCGAT (SEQ. I.D. No. 48) | FIG. 35A |
| wR0075 B3 NDM R | ACTGCCCCGAAACCCGGCATGTCGAGATAGGA (SEQ. I.D. No. 49) | FIG. 35A |

TABLE 14 crRNA sequences used

| Name | Complete crRNA sequence | Spacer sequence | 1st FIG. | PFS |
|---|---|---|---|---|
| Target 1 crRNA | GGGGAUUUAGACUAC CCCAAAAACGAAGGG GACUAAAACuagauugcug uucuaccaaguaauccau (SEQ. I.D. No. 50) | uagauugcuguucuaccaagua auccau (SEQ. I.D. No. 51) | FIG. 2F | C |
| Zika targeting crRNA 1 | GGGGAUUUAGACUAC CCCAAAAACGAAGGG GACUAAAACCAUGUA GUGCGCCACGAGCAA AAUGAUG (SEQ. I.D. No. 52) | CAUGUAGUGCGCCAC GAGCAAAAUGAUG (SEQ. I.D. No. 53) | FIG. 31A | U |
| Zika targeting crRNA 2 | GGGGAUUUAGACUAC CCCAAAAACGAAGGG GACUAAAACUGCUGC CUGCAGCCCUGGGAUC AAGUAC (SEQ. I.D. No. 54) | UGCUGCCUGCAGCCC UGGGAUCAAGUAC (SEQ. I.D. No. 55) | FIG. 33D | G |
| *E. coli* detection crRNA | GGGGAUUUAGACUAC CCCAAAAACGAAGGG GACUAAAACACUUUA CUCCCUUCCUCCCCGC UGAAAG (SEQ. I.D. No. 56) | ACUUUACUCCCUUCC UCCCCGCUGAAAG (SEQ. I.D. No. 57) | FIG. 22B | U |
| *K. pneumoniae* detection crRNA | GGGGAUUUAGACUAC CCCAAAAACGAAGGG GACUAAAACACCUCA UCGCCUUCCUCCCCGC UGAAAG (SEQ. I.D. No. 58) | ACCUCAUCGCCUUCC UCCCCGCUGAAAG (SEQ. I.D. No. 59) | FIG. 34B | U |
| *P. aeruginosa* detection crRNA | GGGGAUUUAGACUAC CCCAAAAACGAAGGG GACUAAAACACUUAC UGCCCUUCCUCCCAAC UUAAAG (SEQ. I.D. No. 60) | ACUUACUGCCCUUCC UCCCAACUUAAAG (SEQ. I.D. No. 61) | FIG. 34B | U |
| *M. tuberculosis* detection crRNA | GGGGAUUUAGACUAC CCCAAAAACGAAGGG GACUAAAACGAACCC GGACCUUCGUCGAUG GUGAAAG (SEQ. I.D. No. 62) | GAACCCGGACCUUCG UCGAUGGUGAAAG (SEQ. I.D. No. 63) | FIG. 34B | U |
| *S. aureus* detection crRNA | GGGGAUUUAGACUAC CCCAAAAACGAAGGG GACUAAAACUUACAC AUAUGUUCUUCCCUA AUAACAG (SEQ. I.D. No. 64) | UUACACAUAUGUUCU UCCCUAAUAACAG (SEQ. I.D. No. 65) | FIG. 34B | G |
| KPC crRNA | GGGGAUUUAGACUAC CCCAAAAACGAAGGG GACUAAAACaUggUUcc gcgacgaggUUggUcagcgc (SEQ. I.D. No. 66) | aUggUUccgcgacgaggUUg gUcagcgc (SEQ. I.D. No. 67) | FIG. 35A | U |
| NDM crRNA | GGGGAUUUAGACUAC CCCAAAAACGAAGGG GACUAAAACcUgccagaca UUcggUgcgagcUggcgg (SEQ. I.D. No. 68) | cUgccagacaUUcggUgcgag cUggcgg (SEQ. I.D. No. 69) | FIG. 35A | C |
| mismatch crRNA 1 | GGGGAUUUAGACUAC CCCAAAAACGAAGGG GACUAAAACAagaUUgc UgUUcUaccaagUaaUccaU (SEQ. I.D. No. 70) | AagaUUgcUgUUcUaccaa gUaaUccaU (SEQ. I.D. No. 71) | FIG. 36A | C |

TABLE 14-continued crRNA sequences used

| Name | Complete crRNA sequence | Spacer sequence | 1st FIG. | PFS |
|---|---|---|---|---|
| mismatch crRNA 2 | GGGGAUUUAGACUAC CCCAAAAACGAAGGG GACUAAAACUUgaUUgc UgUUcUaccaagUaaUccaU (SEQ. I.D. No. 72) | UUgaUUgcUgUUcUaccaa gUaaUccaU (SEQ. I.D. No. 73) | FIG. 36A | C |
| mismatch crRNA 3 | GGGGAUUUAGACUAC CCCAAAAACGAAGGG GACUAAAACUaCaUUgc UgUUcUaccaagUaaUccaU (SEQ. I.D. No. 74) | UaCaUUgcUgUUcUaccaa gUaaUccaU (SEQ. I.D. No. 75) | FIG. 36A | C |
| mismatch crRNA 4 | GGGGAUUUAGACUAC CCCAAAAACGAAGGG GACUAAAACUagUUUgc UgUUcUaccaagUaaUccaU (SEQ. I.D. No. 76) | UagUUUgcUgUUcUaccaa gUaaUccaU (SEQ. I.D. No. 77) | FIG. 36A | C |
| mismatch crRNA 5 | GGGGAUUUAGACUAC CCCAAAAACGAAGGG GACUAAAACUagaAUgc UgUUcUaccaagUaaUccaU (SEQ. I.D. No. 78) | UagaAUgcUgUUcUaccaa gUaaUccaU (SEQ. I.D. No. 79) | FIG. 36A | C |
| mismatch crRNA 6 | GGGGAUUUAGACUAC CCCAAAAACGAAGGG GACUAAAACUagaUAgc UgUUcUaccaagUaaUccaU (SEQ. I.D. No. 80) | UagaUAgcUgUUcUaccaa gUaaUccaU (SEQ. I.D. No. 81) | FIG. 36A | C |
| mismatch crRNA 7 | GGGGAUUUAGACUAC CCCAAAAACGAAGGG GACUAAAACUagaUUCc UgUUcUaccaagUaaUccaU (SEQ. I.D. No. 82) | UagaUUCcUgUUcUaccaa gUaaUccaU (SEQ. I.D. No. 83) | FIG. 36A | C |
| mismatch crRNA 8 | GGGGAUUUAGACUAC CCCAAAAACGAAGGG GACUAAAACUagaUUgG UgUUcUaccaagUaaUccaU (SEQ. I.D. No. 84) | UagaUUgGUgUUcUaccaa gUaaUccaU (SEQ. I.D. No. 85) | FIG. 36A | C |
| mismatch crRNA 9 | GGGGAUUUAGACUAC CCCAAAAACGAAGGG GACUAAAACUagaUUgc AgUUcUaccaagUaaUccaU (SEQ. I.D. No. 86) | UagaUUgcAgUUcUaccaa gUaaUccaU (SEQ. I.D. No. 87) | FIG. 36A | C |
| mismatch crRNA 10 | GGGGAUUUAGACUAC CCCAAAAACGAAGGG GACUAAAACUagaUUgc UCUUcUaccaagUaaUccaU (SEQ. I.D. No. 88) | UagaUUgcUCUUcUaccaa gUaaUccaU (SEQ. I.D. No. 89) | FIG. 36A | C |
| African crRNA 1 | GGGGAUUUAGACUAC CCCAAAAACGAAGGG GACUAAAACGGAUAC UUCAUGAUGCCAGCU GCUGUUC (SEQ. I.D. No. 90) | GGAUACUUCAUGAUG CCAGCUGCUGUUC (SEQ. I.D. No. 91) | FIG. 38A | C |
| African crRNA 2 | GGGGAUUUAGACUAC CCCAAAAACGAAGGG GACUAAAACGGAUUG UUCAUGAUGCCAGCU GCUGUUC (SEQ. I.D. No. 92) | GGAUUGUUCAUGAUG CCAGCUGCUGUUC (SEQ. I.D. No. 93) | FIG. 38A | C |
| American crRNA 1 | GGGGAUUUAGACUAC CCCAAAAACGAAGGG GACUAAAACGGGUAC UUCAUGAUGCCAGCU GCCGUUC (SEQ. I.D. No. 94) | GGGUACUUCAUGAUG CCAGCUGCCGUUC (SEQ. I.D. No. 95) | FIG. 38A | U |
| | | GGGUUGUUCAUGAUG | | |

TABLE 14-continued crRNA sequences used

| Name | Complete crRNA sequence | Spacer sequence | 1st FIG. | PFS |
|---|---|---|---|---|
| American crRNA 2 | GGGGAUUUAGACUACCCCAAAAACGAAGGGGACUAAAACGGGUUGUUCAUGAUGCCAGCUGCCGUUC (SEQ. I.D. No. 96) | CCAGCUGCCGUUC (SEQ. I.D. No. 97) | FIG. 38A | U |
| Dengue strain 3 crRNA 1 | GGGGAUUUAGACUACCCCAAAAACGAAGGGGACUAAAACGGUUAAUCCCUUCUGGUGUGUUGAUGU (SEQ. I.D. No. 98) | GGUUUAAUCCCUUCUGGUGUGUUGAUGU (SEQ. I.D. No. 99) | FIG. 38C | A |
| Dengue strain 3 crRNA 2 | GGGGAUUUAGACUACCCCAAAAACGAAGGGGACUAAAACGGUAAAAUCCCUUCUGGUGUGUUGAUGU (SEQ. I.D. No. 100) | GGUAAAAUCCCUUCUGGUGUGUUGAUGU (SEQ. I.D. No. 101) | FIG. 38C | A |
| Dengue strain 1 crRNA 1 | GGGGAUUUAGACUACCCCAAAAACGAAGGGGACUAAAACGGGUUAAUCCCUUCUGGUGUGUUUAUGU (SEQ. I.D. No. 102) | GGGUUAAUCCCUUCUGGUGUGUUUAUGU (SEQ. I.D. No. 103) | FIG. 38C | A |
| Dengue strain 1 crRNA 2 | GGGGAUUUAGACUACCCCAAAAACGAAGGGGACUAAAACGGGAAAAUCCCUUCUGGUGUGUUUAUGU (SEQ. I.D. No. 104) | GGGAAAAUCCCUUCUGGUGUGUUUAUGU (SEQ. I.D. No. 105) | FIG. 38C | A |
| Shorter African crRNA 1 | GGGGAUUUAGACUACCCCAAAAACGAAGGGGACUAAAACGGAUACUUCAUGAUGCCAGCUGC (SEQ. I.D. No. 106) | GGAUACUUCAUGAUGCCAGCUGC (SEQ. I.D. No. 107) | FIG. 36C | C |
| Shorter African crRNA 2 | GGGGAUUUAGACUACCCCAAAAACGAAGGGGACUAAAACGGAUUGUUCAUGAUGCCAGCUGC (SEQ. I.D. No. 108) | GGAUUGUUCAUGAUGCCAGCUGC (SEQ. I.D. No. 109) | FIG. 36C | C |
| Shorter American crRNA 1 | GGGGAUUUAGACUACCCCAAAAACGAAGGGGACUAAAACGGGUACUUCAUGAUGCCAGCUGC (SEQ. I.D. No. 110) | GGGUACUUCAUGAUGCCAGCUGC (SEQ. I.D. No. 111) | FIG. 36C | U |
| Shorter American crRNA 2 | GGGGAUUUAGACUACCCCAAAAACGAAGGGGACUAAAACGGGUUGUUCAUGAUGCCAGCUGC (SEQ. I.D. No. 112) | GGGUUGUUCAUGAUGCCAGCUGC (SEQ. I.D. No. 113) | FIG. 36C | U |
| rs1467558 crRNA C | GGGGAUUUAGACUACCCCAAAAACGAAGGGGACUAAAACUACUACGCUUCAGCCUACUGCAAAUCCA (SEQ. I.D. No. 114) | UACUACGCUUCAGCCUACUGCAAAUCCA (SEQ. I.D. No. 115) | FIG. 38B | C |

TABLE 14-continued

| | crRNA sequences used | | | |
|---|---|---|---|---|
| Name | Complete crRNA sequence | Spacer sequence | 1st FIG. | PFS |
| rs1467558 crRNA T | GGGGAUUUAGACUAC CCCAAAAACGAAGGG GACUAAAACUAUUAC GCUUCAGCCUACUGCA AAUCCA (SEQ. I.D. No. 116) | UAUUACGCUUCAGCC UACUGCAAAUCCA (SEQ. I.D. No. 117) | FIG. 38B | C |
| rs2952768 crRNA C | GGGGAUUUAGACUAC CCCAAAAACGAAGGG GACUAAAACGACaGAA AUGUCCUUUCCCAA UCCUAU (SEQ. I.D. No. 118) | GACaGAAAUGUCCUU UUCCCAAUCCUAU (SEQ. I.D. No. 119) | FIG. 38B | A |
| rs2952768 crRNA T | GGGGAUUUAGACUAC CCCAAAAACGAAGGG GACUAAAACGAUaGAA AUGUCCUUUCCCAA UCCUAU (SEQ. I.D. No. 120) | GAUaGAAAUGUCCUU UUCCCAAUCCUAU (SEQ. I.D. No. 121) | FIG. 38B | A |
| rs4363657 crRNA C | GGGGAUUUAGACUAC CCCAAAAACGAAGGG GACUAAAACACCgACU CUUUUUUGUAUUUCC AGUAGA (SEQ. I.D. No. 122) | ACCgACUCUUUUUUG UAUUUCCAGUAGA (SEQ. I.D. No. 123) | FIG. 38B | A |
| rs4363657 crRNA T | GGGGAUUUAGACUAC CCCAAAAACGAAGGG GACUAAAACACUgACU CUUUUUUGUAUUUCC AGUAGA (SEQ. I.D. No. 124) | ACUgACUCUUUUUUG UAUUUCCAGUAGA (SEQ. I.D. No. 125) | FIG. 38B | A |
| rs601338 crRNA A | GGGGAUUUAGACUAC CCCAAAAACGAAGGG GACUAAAACCUAcACC UUCUACCACCACCUCC GCCAG (SEQ. I.D. No. 126) | CUAcACCUUCUACCA CCACCUCCGCCAG (SEQ. I.D. No. 127) | FIG. 38B | G |
| rs601338 crRNA G | GGGGAUUUAGACUAC CCCAAAAACGAAGGG GACUAAAACCUGcACC UUCUACCACCACCUCC GCCAG (SEQ. I.D. No. 128) | CUGcACCUUCUACCA CCACCUCCGCCAG (SEQ. I.D. No. 129) | FIG. 38B | G |
| rs5082 crRNA G | GGGGAUUUAGACUAC CCCAAAAACGAAGGG GACUAAAACGAGaGCA ACAGGAAGCAGGAUU CAGGAUUCCAAGU 130) | GAGaGCAACAGGAAG CCAAGU (SEQ. I.D. No. (SEQ. I.D. No. 131) | FIG. 40A | A |
| rs5082 crRNA A | GGGGAUUUAGACUAC CCCAAAAACGAAGGG GACUAAAACGAAaGCA ACAGGAAGCAGGAUU CCAAGU (SEQ. I.D. No. 132) | GAAaGCAACAGGAAG CAGGAUUCCAAGU (SEQ. I.D. No. 133) | FIG. 40A | A |

TABLE 14-continued crRNA sequences used

| Name | Complete crRNA sequence | Spacer sequence | 1st FIG. | PFS |
|---|---|---|---|---|
| EGFR L858R wild-type crRNA | GGGGAUUUAGACUACCCCAAAAACGAAGGGGACUAAAACCCAGGCCAAAAUCUGUGAUCUUGACAUG (SEQ. I.D. No. 134) | CCAGGCCAAAAUCUGUGAUCUUGACAUG (SEQ. I.D. No. 135) | FIG. 38C | C |
| EGFR L858R mutant crRNA | GGGGAUUUAGACUACCCCAAAAACGAAGGGGACUAAAACCCCGGCCAAAAUCUGUGAUCUUGACAUG (SEQ. I.D. No. 136) | CCCGGCCAAAAUCUGUGAUCUUGACAUG (SEQ. I.D. No. 137) | FIG. 38C | C |
| BRAF V600E wild-type crRNA | GGGGAUUUAGACUACCCCAAAAACGAAGGGGACUAAAACUCAGUGUAGCUAGACCAAAAUCACCUAU (SEQ. I.D. No. 138) | UCAGUGUAGCUAGACCAAAAUCACCUAU (SEQ. I.D. No. 139) | FIG. 38C | A |
| BRAF V600E mutant crRNA | GGGGAUUUAGACUACCCCAAAAACGAAGGGGACUAAAACUCUGUGUAGCUAGACCAAAAUCACCUAU (SEQ. I.D. No. 140) | UCUGUGUAGCUAGACCAAAAUCACCUAU (SEQ. I.D. No. 141) | FIG. 38C | A |
| 23 nt mismatch crRNA 1 | GGGGAUUUAGACUACCCCAAAAACGAAGGGGACUAAAACAAGAUUGCUGUUCUACCAAGUAA (SEQ. I.D. No. 142) | AAGAUUGCUGUUCUACCAAGUAA (SEQ. I.D. No. 143) | FIG. 57D | C |
| 23 nt mismatch crRNA 2 | GGGGAUUUAGACUACCCCAAAAACGAAGGGGACUAAAACUUGAUUGCUGUUCUACCAAGUAA (SEQ. I.D. No. 144) | UUGAUUGCUGUUCUACCAAGUAA (SEQ. I.D. No. 145) | FIG. 57D | C |
| 23 nt mismatch crRNA 4 | GGGGAUUUAGACUACCCCAAAAACGAAGGGGACUAAAACUAGUUUGCUGUUCUACCAAGUAA (SEQ. I.D. No. 146) | UAGUUUGCUGUUCUACCAAGUAA (SEQ. I.D. No. 147) | FIG. 57D | C |
| 23 nt mismatch crRNA 5 | GGGGAUUUAGACUACCCCAAAAACGAAGGGGACUAAAACUAGAAUGCUGUUCUACCAAGUAA (SEQ. I.D. No. 148) | UAGAAUGCUGUUCUACCAAGUAA (SEQ. I.D. No. 149) | FIG. 57D | C |
| 23 nt mismatch crRNA 6 | GGGGAUUUAGACUACCCCAAAAACGAAGGGGACUAAAACUAGAUAGCUGUUCUACCAAGUAA (SEQ. I.D. No. 150) | UAGAUAGCUGUUCUACCAAGUAA (SEQ. I.D. No. 151) | FIG. 57D | C |
| 23 nt mismatch crRNA 7 | GGGGAUUUAGACUACCCCAAAAACGAAGGGGACUAAAACUAGAUUCCUGUUCUACCAAGUAA (SEQ. I.D. No. 152) | UAGAUUCCUGUUCUACCAAGUAA (SEQ. I.D. No. 153) | FIG. 57D | C |
| 20 nt mismatch crRNA 1 | GGGGAUUUAGACUACCCCAAAAACGAAGGGGACUAAAACAAGAUUGCUGUUCUACCAAG (SEQ. I.D. No. 154) | AAGAUUGCUGUUCUACCAAG (SEQ. I.D. No. 155) | FIG. 57F | C |

TABLE 14-continued crRNA sequences used

| Name | Complete crRNA sequence | Spacer sequence | 1st FIG. | PFS |
|---|---|---|---|---|
| 20 nt mismatch crRNA 2 | GGGGAUUUAGACUACCCCAAAAACGAAGGGGACUAAAACUUGAUUGCUGUUCUACCAAG (SEQ. I.D. No. 156) | UUGAUUGCUGUUCUACCAAG (SEQ. I.D. No. 157) | FIG. 57F | C |
| 20 nt mismatch crRNA 4 | GGGGAUUUAGACUACCCCAAAAACGAAGGGGACUAAAACUAGUUUGCUGUUCUACCAAG (SEQ. I.D. No. 158) | UAGUUUGCUGUUCUACCAAG (SEQ. I.D. No. 159) | FIG. 57F | C |
| 20 nt mismatch crRNA 5 | GGGGAUUUAGACUACCCCAAAAACGAAGGGGACUAAAACUAGAAUGCUGUUCUACCAAG (SEQ. I.D. No. 160) | UAGAAUGCUGUUCUACCAAG (SEQ. I.D. No. 161) | FIG. 57F | C |
| 20 nt mismatch crRNA 6 | GGGGAUUUAGACUACCCCAAAAACGAAGGGGACUAAAACUAGAUAGCUGUUCUACCAAG (SEQ. I.D. No. 162) | UAGAUAGCUGUUCUACCAAG (SEQ. I.D. No. 163) | FIG. 57F | C |
| 20 nt mismatch crRNA 7 | GGGGAUUUAGACUACCCCAAAAACGAAGGGGACUAAAACUAGAUUCCUGUUCUACCAAG (SEQ. I.D. No. 164) | UAGAUUCCUGUUCUACCAAG (SEQ. I.D. No. 165) | FIG. 57F | C |
| target mismatch 4 mismatch crRNA 1 | GGGGAUUUAGACUACCCCAAAAACGAAGGGGACUAAAACCUAGAUUGCUGUUCUACCAAGUAAUCCA (SEQ. I.D. No. 166) | CUAGAUUGCUGUUCUACCAAGUAAUCCA (SEQ. I.D. No. 167) | FIG. 58B | C |
| target mismatch 4 mismatch crRNA 2 | GGGGAUUUAGACUACCCCAAAAACGAAGGGGACUAAAACGAAGAUUGCUGUUCUACCAAGUAAUCCA (SEQ. I.D. No. 168) | GAAGAUUGCUGUUCUACCAAGUAAUCCA (SEQ. I.D. No. 169) | FIG. 58B | C |
| target mismatch 4 mismatch crRNA 3 | GGGGAUUUAGACUACCCCAAAAACGAAGGGGACUAAAACGUUGAUUGCUGUUCUACCAAGUAAUCCA (SEQ. I.D. No. 170) | GUUGAUUGCUGUUCUACCAAGUAAUCCA (SEQ. I.D. No. 171) | FIG. 58B | C |
| target mismatch 4 mismatch crRNA 5 | GGGGAUUUAGACUACCCCAAAAACGAAGGGGACUAAAACGUAGUUUGCUGUUCUACCAAGUAAUCCA (SEQ. I.D. No. 172) | GUAGUUUGCUGUUCUACCAAGUAAUCCA (SEQ. I.D. No. 173) | FIG. 58B | C |
| target mismatch 4 mismatch crRNA 6 | GGGGAUUUAGACUACCCCAAAAACGAAGGGGACUAAAACGUAGAAUGCUGUUCUACCAAGUAAUCCA (SEQ. I.D. No. 174) | GUAGAAUGCUGUUCUACCAAGUAAUCCA (SEQ. I.D. No. 175) | FIG. 58B | C |
| target mismatch 4 mismatch crRNA 7 | GGGGAUUUAGACUACCCCAAAAACGAAGGGGACUAAAACGUAGAUAGCUGUUCUACCAAGUAAUCCA (SEQ. I.D. No. 176) | GUAGAUAGCUGUUCUACCAAGUAAUCCA (SEQ. I.D. No. 177) | FIG. 58B | C |

TABLE 14-continued crRNA sequences used

| Name | Complete crRNA sequence | Spacer sequence | 1st FIG. | PFS |
|---|---|---|---|---|
| target mismatch 5 mismatch crRNA 2 | GGGGAUUUAGACUAC CCCAAAAACGAAGGG GACUAAAACACUAGA UUGCUGUUCUACCAA GUAAUCC (SEQ. I.D. No. 178) | ACUAGAUUGCUGUUC UACCAAGUAAUCC (SEQ. I.D. No. 179) | FIG. 58B | C |
| target mismatch 5 mismatch crRNA 3 | GGGGAUUUAGACUAC CCCAAAAACGAAGGG GACUAAAACAGAAGA UUGCUGUUCUACCAA GUAAUCC (SEQ. I.D. No. 180) | AGAAGAUUGCUGUUC UACCAAGUAAUCC (SEQ. I.D. No. 181) | FIG. 58B | C |
| target mismatch 5 mismatch crRNA 4 | GGGGAUUUAGACUAC CCCAAAAACGAAGGG GACUAAAACAGUUGA UUGCUGUUCUACCAA GUAAUCC (SEQ. I.D. No. 182) | AGUUGAUUGCUGUUC UACCAAGUAAUCC (SEQ. I.D. No. 183) | FIG. 58B | C |
| target mismatch 5 mismatch crRNA 6 | GGGGAUUUAGACUAC CCCAAAAACGAAGGG GACUAAAACAGUAGU UUGCUGUUCUACCAA GUAAUCC (SEQ. I.D. No. 184) | AGUAGUUUGCUGUUC UACCAAGUAAUCC (SEQ. I.D. No. 185) | FIG. 58B | C |
| target mismatch 5 mismatch crRNA 7 | GGGGAUUUAGACUAC CCCAAAAACGAAGGG GACUAAAACAGUAGA AUGCUGUUCUACCAA GUAAUCC (SEQ. I.D. No. 186) | AGUAGAAUGCUGUUC UACCAAGUAAUCC (SEQ. I.D. No. 187) | FIG. 58B | C |
| target mismatch 5 mismatch crRNA 8 | GGGGAUUUAGACUAC CCCAAAAACGAAGGG GACUAAAACAGUAGA UAGCUGUUCUACCAA GUAAUCC (SEQ. I.D. No. 188) | AGUAGAUAGCUGUUC UACCAAGUAAUCC (SEQ. I.D. No. 189) | FIG. 58B | C |
| target mismatch 6 mismatch crRNA 3 | GGGGAUUUAGACUAC CCCAAAAACGAAGGG GACUAAAACGACUAG AUUGCUGUUCUACCA AGUAAUC (SEQ. I.D. No. 190) | GACUAGAUUGCUGUU CUACCAAGUAAUC (SEQ. I.D. No. 191) | FIG. 58B | C |
| target mismatch 6 mismatch crRNA 4 | GGGGAUUUAGACUAC CCCAAAAACGAAGGG GACUAAAACGAGAAG AUUGCUGUUCUACCA AGUAAUC (SEQ. I.D. No. 192) | GAGAAGAUUGCUGUU CUACCAAGUAAUC (SEQ. I.D. No. 193) | FIG. 58B | C |
| target mismatch 6 mismatch crRNA 5 | GGGGAUUUAGACUAC CCCAAAAACGAAGGG GACUAAAACGAGUUG AUUGCUGUUCUACCA AGUAAUC (SEQ. I.D. No. 194) | GAGUUGAUUGCUGUU CUACCAAGUAAUC (SEQ. I.D. No. 195) | FIG. 58B | C |
| target mismatch 6 mismatch crRNA 7 | GGGGAUUUAGACUAC CCCAAAAACGAAGGG GACUAAAACGAGUAG UUUGCUGUUCUACCA AGUAAUC (SEQ. I.D. No. 196) | GAGUAGUUUGCUGUU CUACCAAGUAAUC (SEQ. I.D. No. 197) | FIG. 58B | C |

TABLE 14-continued crRNA sequences used

| Name | Complete crRNA sequence | Spacer sequence | 1st FIG. | PFS |
|---|---|---|---|---|
| target mismatch 6 mismatch crRNA 8 | GGGGAUUUAGACUAC CCCAAAAACGAAGGG GACUAAAACGAGUAG AAUGCUGUUCUACCA AGUAAUC (SEQ. I.D. No. 198) | GAGUAGAAUGCUGUU CUACCAAGUAAUC (SEQ. I.D. No. 199) | FIG. 58B | C |
| target mismatch 6 mismatch crRNA 9 | GGGGAUUUAGACUAC CCCAAAAACGAAGGG GACUAAAACGAGUAG AUAGCUGUUCUACCA AGUAAUC (SEQ. I.D. No. 200) | GAGUAGAUAGCUGUU CUACCAAGUAAUC (SEQ. I.D. No. 201) | FIG. 58B | C |

TABLE 15

RNA and DNA targets used in this Example

| Name | Sequence | 1st FIG |
|---|---|---|
| ssRNA 1 (C PFS) | gggGGCCAGUGAAUUCGAGCUCGGUACCCGGGGAUCCUCUAGAAA UAUGGAUUACUUGGUAGAACAGCAAUCUACUCGACCUGCAGGCA UGCAAGCUUGGCGUAAUCAUGGUCAUAGCUGUUUCCUGUGUUUA UCCGCUCACAAUUCCACACAACAUACGAGCCGGAAGCAUAAAG (SEQ. I.D. No. 202) | FIG. 2F |
| ssRNA 1 (G PFS) | gggGGCCAGUGAAUUCGAGCUCGGUACCCGGGGAUCCUCUAGAAA UAUGGAUUACUUGGUAGAACAGCAAUCUAGUCGACCUGCAGGCA UGCAAGCUUGGCGUAAUCAUGGUCAUAGCUGUUUCCUGUGUUUA UCCGCUCACAAUUCCACACAACAUACGAGCCGGAAGCAUAAAG (SEQ. I.D. No. 203) | FIG. 2F |
| ssRNA 1 (A PFS) | gggGGCCAGUGAAUUCGAGCUCGGUACCCGGGGAUCCUCUAGAAA UAUGGAUUACUUGGUAGAACAGCAAUCUAAUCGACCUGCAGGCA UGCAAGCUUGGCGUAAUCAUGGUCAUAGCUGUUUCCUGUGUUUA UCCGCUCACAAUUCCACACAACAUACGAGCCGGAAGCAUAAAG (SEQ. I.D. No. 204) | FIG. 2F |
| ssRNA 1 (U PFS) | gggGGCCAGUGAAUUCGAGCUCGGUACCCGGGGAUCCUCUAGAAA UAUGGAUUACUUGGUAGAACAGCAAUCUAUUCGACCUGCAGGCA UGCAAGCUUGGCGUAAUCAUGGUCAUAGCUGUUUCCUGUGUUUA UCCGCUCACAAUUCCACACAACAUACGAGCCGGAAGCAUAAAG (SEQ. I.D. No. 205) | FIG. 2F |
| ssDNA 1 | GGCCAGTGAATTCGAGCTCGGTACCCGGGGATCCTCTAGAAATATG GATTACTTGGTAGAACAGCAATCTACTCGACCTGCAGGCATGCAAG CTTGGCGTAATCATGGTCATAGCTGTTTCCTGTGTTTATCCGCTCAC AATTCCACACAACATACGAGCCGGAAGCATAAAG (SEQ. I.D. No. 206) | FIG. 27 |
| DNA 2 | GAGTACGTCCGCTTCACCGGCTACCCCTGCTCCTGGACCTTCTACC ACCACCTCCGCCAGGAGATCCTCCAGGAGTTCACCCTGCACGACCA CGTGCGGGAGGAGGCCCAGAAGTTCCTGCGGGGCCTGCAGGTGAA CGGGAGCCGGCCGGGCACCTTTGTAGGGGTCCATGTTCGCCGAGG GGACTAT (SEQ. I.D. No. 207) | FIG. 54B |
| ZIKV in lentivirus | agcuggaguguuguuugguaugggcaaagggaugccauucuacgcaugggacuuuggaguccgc ugcuaaugauagguugcuacucacaauuaacaccccugacccuaauaguggccaucauuuugcucg uggcgcacuacauguacuugaucccagggcugcaggcagcagcugcgcugcugcccagaagagaa cggcagcuggcaucaugaagaacccuguuguggauggaauaguggugacugacauugacacaauga caauugaccccccaaguggagaaaaagaugggacaggugcuacucauagcaguagccgucuccagcgc caua (SEQ. I.D. No. 208) | FIG. 31B |
| DENV in lentivirus | ggcagcuauauugaugggaacuugacaagggaugccaauaucgaagauggacauaggaguuccacu ucucgccuuaggugugcuauuucccaggugaaccccauugacacugacagcggcggugguugauguuagu ggcucauuaugccauaauuggaccaggacugcaagcaaaggccacuagagaagcucaaaaaaggaca gcggccggaauaaugaaaaauccaaccguagacgggauuguugcaauagacuuggauccugugguu uaugauacaaaauuugaaaaacagcuaggccaaauaauguuacugauacuuuugacaucacagauccc uc (SEQ. I.D. No. 209) | FIG. 31B |

TABLE 15-continued

RNA and DNA targets used in this Example

| Name | Sequence | 1st FIG |
|---|---|---|
| Synthetic ZIKV target | gggAGCUGGAGUGUUGUUUGGUAUGGGCAAAGGGAUGCCAUUCU ACGCAUGGGACUUUGGAGUCCCGCUGCUAAUGAUAGGUUGCUAC UCACAAUUAACACCCCUGACCCUAAUAGUGGCCAUCAUUUUGCU CGUGGCGCACUACAUGUACUUGAUCCCAGGGCUGCAGGCAGCAG CUGCGCGUGCUGCCCAGAAGAGAACGGCAGCUGGCAUCAUGAAG AACCCUGUUGUGGAUGGAAUAGUGGUGACUGACAUUGACACAAU GACAAUUGACCCCCAAGUGGAGAAAAAGAUGGGACAGGUGCUAC UCAUAGCAGUAGCCGUCUCCAGCGCCAUA (SEQ. I.D. No. 210) | FIG. 33D |
| Synthetic African ZIKV target | gggAACCUUGAUAGUGGCUAUCAUUCUGCUUGUGGCACACUAUAU GUACUUGAUCCCAGGCCUACAGGCAGCAGCAGCGCGUGCUGCCC AGAAGAGAACAGCAGCUGGCAUCAUGAAGAAUCCCGUUGUGGAU GGAAUAGUGGUAACUGACAUUGACACAAUGACAAUUGACC (SEQ. I.D. No. 211) | FIG. 37A |
| Synthetic American ZIKV target | gggGACCCUAAUAGUGGCCAUCAUUUUGCUCGUGGCGCACUACAU GUACUUGAUCCCAGGGCUGCAGGCAGCAGCUGCGCGUGCUGCCC AGAAGAGAACGGCAGCUGGCAUCAUGAAGAACCCUGUUGUGGAU GGAAUAGUGGUGACUGACAUUGACACAAUGACAAUUGACC (SEQ. I.D. No. 212) | FIG. 37A |
| Synthetic Dengue strain 1 target | gggAGUACAUAUUCAGGGGCCAACCUCUCAACAAUGACGAAGACC AUGCUCACUGGACAGAAGCAAAAAUGCUGCUGGACAACAUCAAC ACACCAGAAGGGAUUAUACCAGCUCUCUUUGAACCAGAAAGGGA GAAGUCAGCCGCCAUAGACGGUGAAUACCGCCUGAAGGGU (SEQ. I.D. No. 213) | FIG. 37C |
| Synthetic Dengue strain 3 target | gggAGUACAUUUACAUGGGACAGCCUUCAAACAACGAUGAGGAUC ACGCUCAUUGGACAGAAGCAAAAAUGCUCCUUGACAACAUAAAC ACACCAGAAGGGAUUAUCCCAGCCCUCUUUGAGCCGGAGAGAGG AAAAAGUGCAGCAAUAGACGGGGAAUACAGACUGCGGGGU (SEQ. I.D. No. 214) | FIG. 37C |
| ssRNA 2 | gggGGCCAGUGAAUUCGAGCUCGGUACCCGGGGAUCCUCUAGAAA UAUGGAUUACUUGGUAGAACAGCAAUGUACUCGACCUGCAGGCA UGCAAGCUUGGCGUAAUCAUGGUCAUAGCUGUUUCCUGUGUUUA UCCGCUCACAAUUCCACACAACAUACGAGCCGGAAGCAUAAAG (SEQ. I.D. No. 215) | FIG. 36A |
| ssRNA 3 | gggGGCCAGUGAAUUCGAGCUCGGUACCCGGGGAUCCUCUAGAAA UAUGGAUUACUUGGUAGAACAGCUAUGUACUCGACCUGCAGGCA UGCAAGCUUGGCGUAAUCAUGGUCAUAGCUGUUUCCUGUGUUUA UCCGCUCACAAUUCCACACAACAUACGAGCCGGAAGCAUAAAG (SEQ. I.D. No. 216) | FIG. 36A |

TABLE 16 plasmids used in this Example

| Plasmid Name | Description | Link to plasmid map |
|---|---|---|
| pC004 | beta-lactamase screening target | https://benchling.com/s/1PJ1cCwR |
| pC009 | LshCas13a locus into pACYC184 with targeting spacer | https://benchling.com/s/seqylkMuglYmiG4A3VhShZg |
| pC010 | LshCas13a locus into pACYC184 with nontargeting spacer | https://benchling.com/s/seq-2WApFr3zni1GOACyQY8a |
| pC011 | LwCas13a locus into pACYC184 with targeting spacer | https://benchling.com/s/seq-Vyk8qK2fyhzegfNgLJHM |
| pC012 | LwCas13a locus into pACYC184 with nontargeting spacer | https://benchling.com/s/seq-RxZAgPBzBUGQThkxR2Kx |
| pC013 | Twinstrep-SUMO-huLwCas13a for bacterial expression | https://benchling.com/s/seq-66CfLwu7sLMQMbcXe7Ih |

Example 3—Sherlock Detection Using Lateral Flow Paper Strips

Lateral-flow based technology has achieved wide adoption for point of care settings due to its visual readout and its speed of detection. We developed a system for coupling RNase activity with the release of a bead-immobilized reporter bearing FAM and biotin, allowing for detection on commercial lateral flow strips (FIG. 87A). We found that this approach could reliably detect SHERLOCK activity, although with reduced sensitivity compared to fluorescence-based readouts (FIG. 87B, C).

We designed an alternative lateral-flow readout that was based on the destruction, rather than release, of a FAM-biotin reporter. Abundant reporter would accumulate the colorimetric anti-FAM antibody at the first line on the strip, preventing binding of the antibody to protein A on the second line; cleavage of reporter would reduce accumulation at the first line and result in signal on the second line (FIG. 85A). We tested this design for visual detection of Zika and Dengue ssRNA, and found that detection was possible in under 90 minutes with sensitivities to 10 aM condition (FIG. 85B, C and FIG. 88A, B), demonstrating that the lateral flow readout was robust for multiple targets.

Example 4—Applications of Lateral Flow for Soybean Detection and Cancer Diagnostics To further demonstrate the utility of lateral flow SHERLOCK, we applied the system to agricultural and health-related biotechnology scenarios. Detection of genetically modified soybeans is important from both a regulatory perspective and for companies to monitor bean usage. We designed a SHERLOCK assay to genotype the CP4-EPSPS gene, a herbicide tolerant form of 5-enolpyruvulshikimate-3-phosphate synthase from the *Agrobacterium tumefaciens* strain CP4 that renders modified plants resistant to the herbicide Roundup. We designed crRNAs either sensing CP4-EPSPS or lectin, a gene present in wild-type soybeans, and harvested DNA from both Roundup Ready and wild-type soybeans using a rapid crude extraction protocol that takes less than 5 minutes. We found that SHERLOCK was able to successfully genotype the RR beans with very little background from the crude extraction in a rapid amount of time (~20 minutes). Additionally, using quantitative SHERLOCK, we could accurately predict the percentage of RR beans in a mixture of wildtype and RR beans. Because GMO detection would be most applicable as a point-of-care technology in the field, we adapted the SHERLOCK assay for lateral flow and found that we could sensitively genotype beans on the paper strips using a visual readout. Additionally, the lateral flow readout was amenable to rapid detection with a total incubation time of 30 minutes allowing for robust SHERLOCK detection visually on paper (FIG. 89).

With SHERLOCKv1, we validated the technology on cell-free DNA standards to show detection of cancer mutations. With SHERLOCKv2, we were interested in detecting cancer mutations from patient blood samples, which is difficult because cfDNA is typically at very low concentrations ~1 ng/µL and the actual mutation to detect is a small fraction of this 0.1%-5%. We designed a SHERLOCK assay to detect the EGFR L858R mutation and isolated cfDNA from a patient carrying the mutation and a patient free of the mutation. We found that SHERLOCK was capable of successfully detecting the mutation (FIG. 86G) and that the detection could also be accomplished using the lateral flow paper strips with a visual readout (FIG. 86H, I). We also designed a SHERLOCK assay to detect a typical EGFR exon 19 deletion (5 amino acids) involved in lung cancer and found that SHERLOCK could both sensitively detect this genomic alteration via fluorescence (FIG. 86J and FIG. 90A) and on the lateral flow strips (FIG. 86K, L and FIG. 90B, C).

Example 5—Nucleic Acid Detection of Plant Genes Using CRISPR-Cas13

Methods

Protein Expression and Purification of Cas13 and Csm6 Orthologs.

LwaCas13a expression and purification was carried out as described before (Gootenberg et al. Science 356:438-442 (2017)). PsmCas13b and Csm6 orthologs were expressed and purified with a modified protocol. In brief, bacterial expression vectors were transformed into Rosetta™ 2(DE3) pLysS Singles Competent Cells (Millipore). A 12.5 mL starter culture was grown overnight in Terrific Broth 4 growth media (Sigma) (TB), which was used to inoculate 4 L of TB for growth at 37° C. and 300 RPM until an OD600 of 0.5. At this time, protein expression was induced by supplementation with IPTG (Sigma) to a final concentration of 500 µM, and cells were cooled to 18° C. for 16 h for protein expression. Cells were then centrifuged at 5000 g for 15 min at 4° C. Cell pellet was harvested and stored at −80° C. for later purification.

All subsequent steps of the protein purification were performed at 4° C. Cell pellet was crushed and resuspended in lysis buffer (20 mM Tris-HCl, 500 mM NaCl, 1 mM DTT, pH 8.0) supplemented with protease inhibitors (Complete Ultra EDTA-free tablets), lysozyme (500 µg/1 ml), and benzonase followed by high-pressure cell disruption using the LM20 Microfluidizer system at 27,000 PSI. Lysate was cleared by centrifugation for 1 hr at 4° C. at 10,000 g. The supernatant was applied to 5 mL of StrepTactin Sepharose (GE) and incubated with rotation for 1 hr followed by washing of the protein-bound StrepTactin resin three times in lysis buffer. The resin was resuspended in SUMO digest buffer (30 mM Tris-HCl, 500 mM NaCl 1 mM DTT, 0.15% Igepal (NP-40), pH 8.0) along with 250 Units of SUMO protease (250 mg/ml) and incubated overnight at 4° C. with rotation. The suspension was applied to a column for elution and separation from resin by gravity flow. The resin was washed two times with 1 column volume of Lysis buffer to maximize protein elution. The elute was diluted in cation exchange buffer (20 mM HEPES, 1 mM DTT, 5% glycerol, pH 7.0; pH 7.5 for EiCsm6 and LsCsm6) to lower the salt concentration in preparation for cation exchange chromatography to 250 mM.

For cation exchange and gel filtration purification, protein was loaded onto a 5 mL HiTrap SP HP cation exchange column (GE Healthcare Life Sciences) via FPLC (AKTA PURE, GE Healthcare Life Sciences) and eluted over a salt gradient from 250 mM to 2M NaCl in elution buffer (20 mM HEPES, 1 mM DTT, 5% glycerol, pH 7.0). The resulting fractions were tested for presence of recombinant protein by SDS-PAGE, and fractions containing the protein were pooled and concentrated via a Centrifugal Filter Unit (Millipore 50MWCO) to 1 mL in S200 buffer (10 mM HEPES, 1 M NaCl, 5 mM MgCl2, 2 mM DTT, pH 7.0). The concentrated protein was loaded onto a gel filtration column (Superdex® 200 Increase 10/300 GL, GE Healthcare Life Sciences) via FPLC. The resulting fractions from gel filtration were analyzed by SDS-PAGE and fractions containing protein were pooled and buffer exchanged into Storage Buffer (600 mM NaCl, 50 mM Tris-HCl pH 7.5, 5% glycerol, 2 mM DTT) and frozen at −80° C. for storage.

Accession numbers and plasmid maps for all proteins purified in this study are available in Table 17.

TABLE 17

Protein sequences used in this study.

| Abbreviation | Protein name | Strain name | Benchling link | Acession number |
|---|---|---|---|---|
| Lwa | LwaCas13a | Leptotrichia wadei | https://benchling.com/s/seq-66CfLwu7sLMQMbcXe7Ih | WP_021746774.1 |
| Psm | PsmCas13b | Prevotella sp. MA2016 | https://benchling.com/s/seq-v7Q1TzaAyNZIGKNnH3 | WP_036929175 |
| Ei | EiCsm6 | Enterococcus italicus | https://benchling.com/s/seq-YrP8xiVG3rBwxYMgCUH0 | WP_007208953.1 |
| Ls | LsCsm6 | Lactobacillus salivarius | https://benchling.com/s/seq-duuAaForfhsBc53zLY5z | WP_081509150.1 |

Crude Nucleic Acid Extraction from Soybeans.

Rapid nucleic acid extraction was performed as previously described (Wang et al. *Anal Chem* 89:4413-4418 (2017)). Briefly, 20 mg of crushed soybeans was added to 200 μL of extraction buffer (500 mM NaOH and 10 mM EDTA), vortexed for 5 seconds, and incubated for 1 minute at room temperature. After a 1:10 dilution of the supernatant, 0.4 μL of extracted genomic DNA was added to a 204, RPA reaction and used for SHERLOCK.

crRNA Preparation.

For preparation of crRNAs, constructs were ordered as ultramer DNA (Integrated DNA Technologies) with an appended T7 promoter sequence. crRNA DNA was annealed to a short T7 primer (final concentrations 10 uM) and incubated with T7 polymerase overnight at 37° C. using the HiScribe T7 Quick High Yield RNA Synthesis kit (New England Biolabs). crRNAs were purified using RNAXP clean beads (Beckman Coulter) at 2× ratio of beads to reaction volume, with an additional 1.8× supplementation of isopropanol (Sigma).

All crRNA sequences used in this study are available in Table 18. Shown are SEQ ID NO:433-441, with the complete crRNA sequence represented by SEQ ID NO:433, the spacer sequence represented by SEQ ID NO:434, and the direct repeat represented by SEQ ID NO:435. The remaining sequence identifiers follow the same pattern.

Recombinase Polymerase Amplification (RPA)

Primers for RPA were designed using NCBI Primer-BLAST using default parameters, with the exception of amplicon size (between 100 and 140 nt), primer melting temperatures (between 54° C. and 67° C.), and primer size (between 30 and 35 nt). Primers were then ordered as DNA (Integrated DNA Technologies).

RPA reactions run were as instructed with TwistAmp® Basic (TwistDx), with the exception that 280 mM MgAc was added prior to the input template. Reactions were run with 1 of input for 10 minutes at 37° C., unless otherwise described.

For SHERLOCK quantification of nucleic acid, RPA primer concentration tested at a lower 240 nM concentration.

When multiple targets were amplified with RPA, primer concentration was adjusted to a final concentration of 480 nM. That is, 120 nM of each primer for two primer pairs were added for duplex detection.

All RPA primers used in this study are available in Table 19. Shown are SEQ ID NO:442-447, with the forward primer sequences represented by SEQ ID NO:442 and 445, the forward primer sequence with T7RNAP promoter sequences represented by SEQ ID NO:443 and 446, and the reverse primer sequence represented by SEQ ID NO:444 and 447.

TABLE 18 crRNA sequences used in this study.

Figure 1:
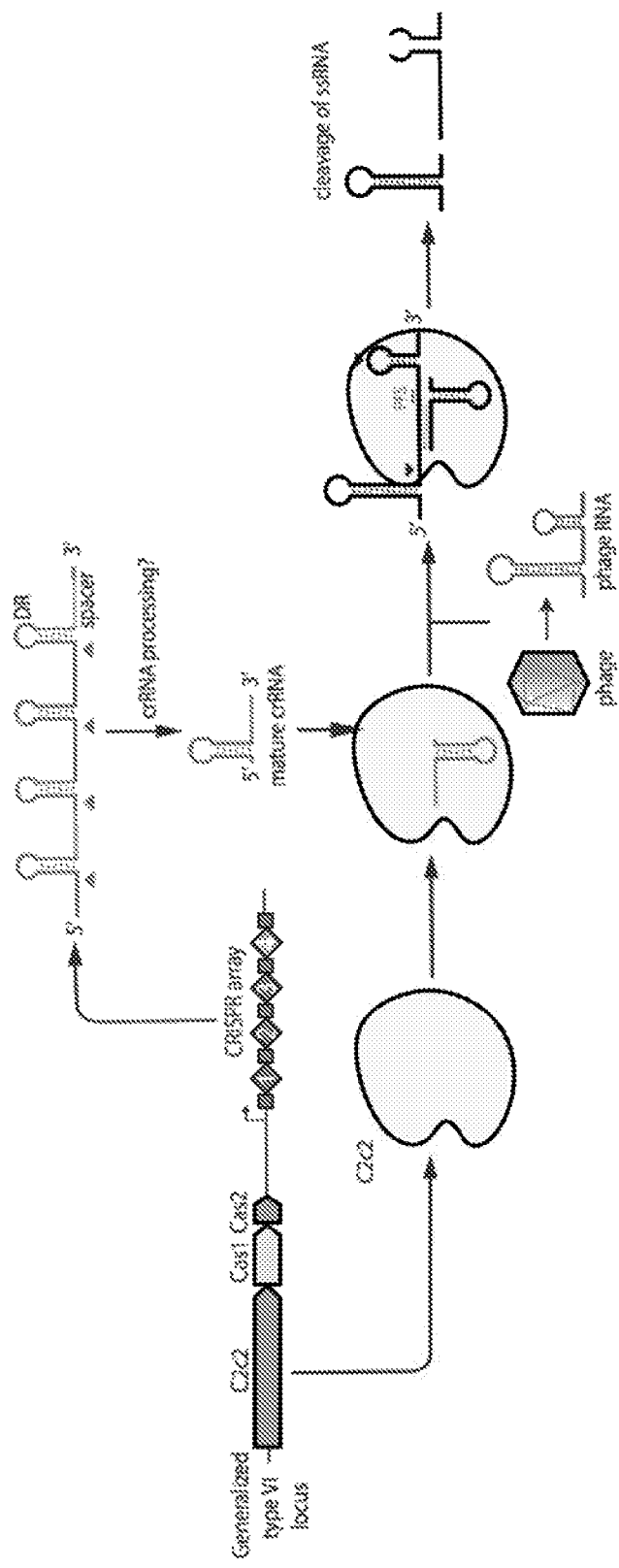
FIG. 1—is a schematic of an example C2c2 based CRISPR effector system.

| Name | Ortholog | Complete crRNA sequence | Spacer sequence | Direct repeat | Target | 1st FIG. |
|---|---|---|---|---|---|---|
| CP4 ESPS crRNA LwaCas13a | LwaCas13a | GATTTAGACTACCCCAAACGAAGGG GACTAAAACgtaggtgatcggcgcggcgtcttcggc | gtaggtgatcggcgtcg gcggtcttcggc | GATTTAGACTAC CCCAAAAACGAA GGGGACTAAAAC | CP4 EPSPS | FIG. 1 |
| Lectin crRNA LwaCas13a | LwaCas13a | GATTTAGACTACCCCAAACCAGGG GACTAAAACggggtggagtagagggcgcgaccaaga g | ggggtggagtagaggg cgcgaccaagag | GATTTACTACTAC CCCAAAAACGAA GGGGACTAAAAC | Lectin | FIG. 1 |
| Lectin crRNA PsmCas13b | PsmCas13b | tgggggtggagtagagggcgcgaccaagagGTTGTAGA AGCTTATCGTTTGGATAGGTATGACAAC | tgggggtggagtagag ggcgcgaccaagag | GTTGTAGAAGCT TATCGTTTGGAT AGGTATGACAAC | Lecin | FIG. 1 |

TABLE 19

RPA primers used in this study.

| Target | Forward primer sequence | Forward primer sequence (with T7 RNAP promoter) | Reverse primer sequence | 1st FIG. |
|---|---|---|---|---|
| CP4 EPSPS | gtgaccgtcttcccgttaccttg | gaaatTAATACGACTCACTATAGGGgtgaccgtcttcccg ttaccttg | ctcgatgaccgtcgtgatgcc | FIG. 1 |
| Lectin | TCAATAAGGTTGACGA AAACGGCAC | gaaatTAATACGACTCACTATAGGGTCAATAAGG TTGACGAAAACGGCAC | TAGAAGGTGAAGTTGA AGGAAGCGG | FIG. 1 |

Fluorescent Cleavage Assay.

Detection assays were performed with 45 nM purified Cas13, 22.5 nM crRNA, quenched fluorescent RNA reporter (125 nM RNAse Alert v2, Thermo Scientific, homopolymer and di-nucleotide reporters (IDT); 250 nM for polyA Trilink reporter), 0.5 µL murine RNase inhibitor (New England Biolabs), 25 ng of background total human RNA (purified from HEK293FT culture), and varying amounts of input nucleic acid target, unless otherwise indicated, in nuclease assay buffer (20 mM HEPES, 60 mM NaCl, 6 mM $MgCl_2$, pH 6.8). Reactions were allowed to proceed for 30 min-3 hr at 37° C. (unless otherwise indicated) on a fluorescent plate reader (BioTek) with fluorescent kinetics measured every 5 min.

All cleavage reporters used in this study are available in Table 20. Shown are SEQ ID NO:448-451.

TABLE 20

RNA reporters used in this study.

| Name | Sequence | Fluorophore | 1st Fig. |
|---|---|---|---|
| poly U reporter | /56-FAM/rUrUrUrUrU/ 3IABkFQ/ | FAM | FIG. 1 |
| poly A reporter | /56-FAM/rArArArArA/ 3IABkFQ/ | FAM | FIG. 1 |
| poly U reporter for multiplexing | /5HEX/rUrUrUrUrU/ 3IABkFQ/ | HEX | FIG. 1 |
| Literal flow reporter with FAM/Biotin | /56-FAM/mArArUrGrGrC mAmArArUrGrGrCmA/ 3Bio/ | NIA | FIG. 1 |

SHERLOCK Nucleic Acid Detection.

Detection assays were performed with 45 nM purified Cas13, 22.5 nM crRNA, quenched fluorescent RNA reporter (125 nM RNAse Alert v2 and 250 nM for poly A Trilink reporter), 0.5 µL murine RNase inhibitor (New England Biolabs), 25 ng of background total human RNA (purified from HEK293FT culture), and 1 uL of RPA reaction in nuclease assay buffer (20 mM HEPES, 60 mM NaCl, 6 mM $MgCl_2$, pH 6.8), rNTP mix (1 mM final, NEB), 0.6 µL T7 polymerase (Lucigen) and 3 mM $MgCl_2$. Reactions were allowed to proceed for 30 min-3 hr at 37° C. (unless otherwise indicated) on a fluorescent plate reader (BioTek) with fluorescent kinetics measured every 5 min.

Cas13-Csm6 Fluorescent Cleavage Assay.

Cas13-Csm6 combined fluorescent cleavage assays were performed as described for standard Cas13 fluorescent cleavage reactions with the following modifications. Csm6 protein was added to 10 nM final concentration, 400 nM of Csm6 fluorescent reporter and 500 nM Csm6 activator unless otherwise indicated. Because of the interference of rNTPs with Csm6 activity, the IVT was performed in the RPA pre-amplification step and then 1 µL of this reaction was added as input to the Cas13-Csm6 cleavage assay.

All Csm6 activators used in this study are available in Table 21 (SEQ ID NO:452).

TABLE 21

Csm6 activator sequence used in this study.

| Name | Sequence | 1st Fig. |
|---|---|---|
| Csm6 polyA polyU probes for U cutters 6 As | rArArArArArArUrUrU | Fig. S3 |

Lateral Flow Readout of Cas13 Activity Using FAM-Biotin Reporters.

For lateral flow detection, the RPA was run for 10 minutes and the SHERLOCK-LwaCas13a reactions were run for 20 minutes, unless otherwise indicated, and the reaction was set up as indicated above except with the fluorescent reporter replaced with 1 uM final concentration of FAM-RNA-biotin reporter. After incubation, the entire 20 µL LwaCas13a reaction was added to 100 µL of HybriDetect 1 assay buffer (Milenia) and run on HybriDetect 1 lateral flow strips (Milenia).

Results

SHERLOCK takes advantage of the conditional promiscuous RNase activity of Cas13, referred to as collateral effect (Abudayyeh et al. Science 353, aaf5573, doi:10.1126/science.aaf5573 (2016)), where Cas13 enzymes cleave non-CRISPR RNA (crRNA) targeted RNA species in solution upon target RNA recognition. By combining Cas13 with a quenched fluorescent RNA reporter (Abudayyeh et al. Science 353, aaf5573, doi:10.1126/science.aaf5573 (2016); East-Seletsky et al. Nature 538:270-273 (2016)) or RNA lateral flow reporter (Gootenberg et al.), SHERLOCK can generate a fluorescent or colorimetric lateral flow readout upon Cas13 recognition of target nucleic acid species. We most recently developed the SHERLOCKv2 platform, which combines same-sample multiplexing, lateral flow visual readouts, quantitation, and Csm6 amplification of signal detection (Gootenberg et al.). Here, we develop a SHERLOCKv2 method specific for agricultural applications, focusing on soybean genotyping and trait quantification for surveillance of GMOs.

Detection of soybean traits is important for worldwide surveillance of GMO traits in the food supply, and a number of detection methods have been developed for detection of the most common trait, the Roundup Ready (RR) resistance gene (Wang et al. Food Control 29:213-220 (2013); Wu et al. Int J Mot Sci 13:1919-1932 92012); Guan et al. Food Anal Method 3:313-320 (2010)). However, these methods suffer from a number of limitations, including requiring instrumentation, poor sensitivity above attomolar concentrations, and incubation times longer than 30 minutes. To enable a CRISPR-based diagnostic for soybean trait detection using SHERLOCK, we first established a rapid DNA extraction strategy for soybean (Glycine max) seeds that allows for direct SHERLOCK detection without prior DNA purification (FIG. 91A). By producing ground seed material with simple hand tools and rehydrating this material in extraction solution, we accomplished efficient extraction of genomic DNA and nucleic acid pre-amplification by RPA. We developed a Cas13 assay for detection by designing crRNAs against the gene encoding enzyme 5-enolpyruvyl-shikimate 3-phosphate synthase (EPSPS) from Agrobacterium sp. strain CP4 (CP4 EPSPS), which confers resistance to Roundup, and the housekeeping gene lectin as a control. We found that Cas13 detection via fluorescence on pre-amplified crude soybean extracts was able to accurately identify the CP4 EPSPS gene in only RR soybeans (FIG. 91B, FIG. 92A-B). To evaluate the ability of SHERLOCK to quantify GM seed content in heterogeneous mixtures, we optimized SHERLOCK to quantify CP4 EPSPS from combinations of wild type and RR soybeans. Using isolated genomic DNA from seed mixtures, we were able to distinguish 20% differences in CP4 EPSPS transgene amount and establish a standard curve for GM-content estimation in 30 minutes (FIG. 91C, FIG. 93A-C).

Concurrent detection of lectin or other housekeeping genes is important as a positive control and for loading normalization, but it is inconvenient to run a reaction for each individual crRNA, particularly in cases where sample amount is limiting or DNA content varies between aliquots. By characterizing the base cleavage preferences of Cas13 orthologs, we found orthologs with mutually exclusive base preferences, allowing for collateral cleavage to be measured by orthogonal reporters in different spectral channels (Gootenberg et al.) (FIG. 91D). We therefore developed an assay around LwaCas13a using a poly-uridine RNA reporter and PsmCas13b using a poly-adenine reporter. Using a LwaCas13a crRNA complementary to the CP4 EPSPS gene and a PsmCas13b crRNA against the lectin gene, we were able to detect both genes in the same reaction and correctly classified the RR soybeans as having the CP4 EPSPS gene (FIG. 91E). The in-sample detection of lectin allows us to ascertain that soybean material was present even though the resistance transgene is not detected.

In many field applications, instrumentation may not be available for readout of a fluorescent signal. For easier visual detection, we created a reporter in SHERLOCKv2 (Gootenberg et al.) to be compatible with lateral flow strip-based readouts by replacing the quenched fluorescent RNA reporter with a RNA functionalized with biotin and FAM on opposite ends (FIG. 91F). In the absence of reporter RNA cleavage, the RNA reporter is adsorbed at a streptavidin line and captures anti-FAM antibodies labeled with gold nanoparticles. If the RNA reporter is destroyed by the collateral effect, then antibody will flow through to a second capture line. To demonstrate this concept with rapid RR soybean detection, we pre-amplified the CP4 EPSPS transgene with RPA from crude soybean extract in 10 minutes and then performed a LwaCas13a detection reaction with the lateral flow RNA reporter in 20 minutes, resulting in lateral flow signal only in DNA from transgenic RR seeds (FIG. 91G, H).

We also find that signal detection of the CP4 EPSPS gene can be enhanced by ~3× by combining the type III CRISPR-associated endoribonuclease Csm6 (Kazlauskiene et al. Science 357:605-609 (2017); Niewoehner et al. Nature 548: 543-548 92017)) into the SHERLOCK reaction (Gootenberg et al.) (FIG. 94). By using LwaCas13a collateral activity to generate a hexadenylate substrate with a 2', 3' cyclic phosphate to stimulate Csm6 cleavage activity, we can activate both EiCsm6 and LsCsm6 to cause signal amplification and thus greater signal detection in the SHERLOCK assay (FIG. 94).

In summary, the SHERLOCK technology provides a useful platform for many biotechnological and agricultural applications, including surveillance of GMO traits across the world and rapid and early detection of plant pathogens or pests.

Example 6

Another goal of SHERLOCK was engineering a visual readout of activity requiring no additional instrumentation. Applicant first tested a colorimetric RNase reporter based upon gold nanoparticle cluster disaggregation (20, 21), but the readout out in this particular context required a level of RNase activity beyond what Cas13 collateral activity was able to achieve (FIG. 95). Applicant then designed a lateral-flow readout that was based on the destruction of a FAM-biotin reporter, allowing for detection on commercial lateral flow strips. Abundant reporter accumulates anti-FAM antibody-gold nanoparticle conjugates at the first line on the strip, preventing binding of the antibody-gold conjugates to protein A on the second line; cleavage of reporter would reduce accumulation at the first line and result in signal on the second line (FIG. 96). We tested this design for instrument-free detection of ZIKV or DENV ssRNA, and found that detection was possible in under 90 minutes with sensitivities down to the 2 aM condition (FIG. 96 and FIG. 97). Moreover, Applicant found that they could do rapid genomic DNA extraction from human saliva (<10 min) and input this directly into SHERLOCK without purification for rapid genotyping in under 23 minutes by fluorescence and 2 hours by lateral flow (FIG. 98). This exemplifies a closed-tube assay format with the entire SHERLOCK reaction being performed in a one-pot assay without any sample purification.

Figure 99:
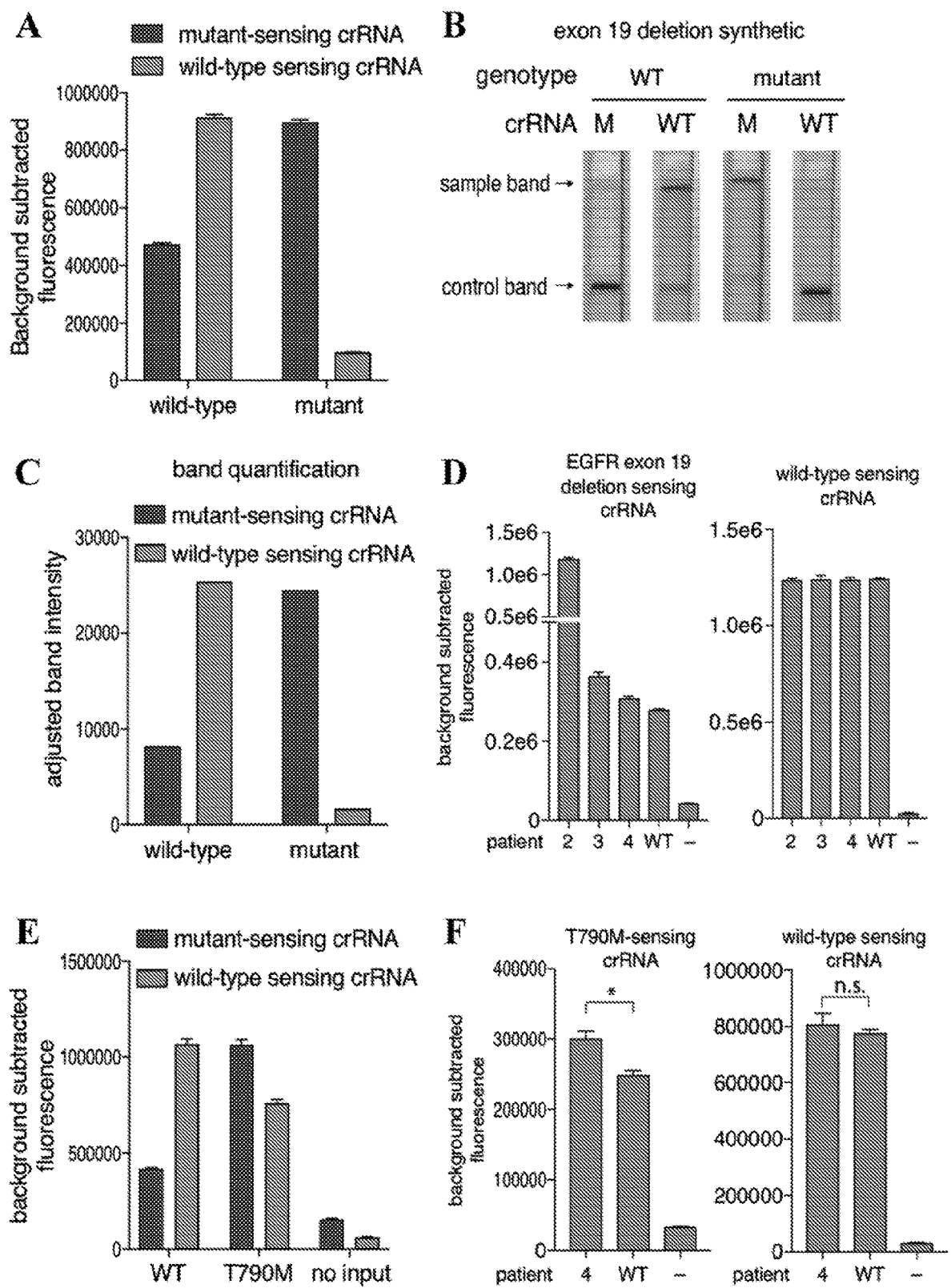

Applicant also applied the system to create a rapid and portable paper test for mutation detection in liquid biopsies of non-small cell lung cancer (NSCLC) patients. Applicant designed SHERLOCK assays to detect either the EGFR L858R mutation or the exon 19 deletion (5 amino acids) and isolated cfDNA from patients with or without these mutations (FIG. 96), as verified by targeted sequencing (Table 28). SHERLOCK successfully detected these mutations, both with fluorescence based readout (FIG. 96) and lateral flow-based readout (FIG. 96 and FIG. 99). Fluorescence-based SHERLOCK was also able to detect a different common EGFR mutation, T790M, in synthetic and patient cfDNA liquid biopsy samples (FIG. 99(e)(f)).

To improve the robustness of the detection and reduce the likelihood of false positive readout, we combined Csm6 with Cas13 detection on lateral flow (FIG. 96). We tested lateral flow reporters of various sequence and length in the presence of Csm6 and activator, and found that a long A-C reporter demonstrated strong cleavage signal (FIG. 100A, B). We used this reporter in combination with the Cas13 lateral flow reporter for rapid detection of DENV ssRNA relying solely on Csm6 for amplification (i.e., in the absence of RPA) (FIG. 96(L)). We subsequently combined RPA, Cas13/Csm6, and lateral flow readout to detect an acyltransferase target, and found that the increase in signal conferred by Csm6 allowed for more rapid detection by lateral flow (FIG. 100C-D) with reduced background.

Materials and Methods
Protein Expression and Purification of Cas13 and Csm6 Orthologs LwaCas13a expression and purification was carried out as described before (3) with minor modifications and is detailed below. LbuCas13a, LbaCas13a, Cas13b and Csm6 orthologs were expressed and purified with a modified protocol. In brief, bacterial expression vectors were transformed into Rosetta™ 2(DE3)pLysS Singles Competent Cells (Millipore). A 12.5 mL starter culture was grown overnight in Terrific Broth 4 growth media (Sigma) (TB), which was used to inoculate 4 L of TB for growth at 37° C. and 300 RPM until an OD600 of 0.5. At this time, protein expression was induced by supplementation with IPTG (Sigma) to a final concentration of 500 µM, and cells were cooled to 18° C. for 16 h for protein expression. Cells were then centrifuged at 5000 g for 15 min at 4° C. Cell pellet was harvested and stored at −80° C. for later purification.

All subsequent steps of the protein purification were performed at 4° C. Cell pellet was crushed and resuspended in lysis buffer (20 mM Tris-HCl, 500 mM NaCl, 1 mM DTT, pH 8.0) supplemented with protease inhibitors (Complete Ultra EDTA-free tablets), lysozyme (500 µg/1 ml), and benzonase followed by high-pressure cell disruption using the LM20 Microfluidizer system at 27,000 PSI. Lysate was cleared by centrifugation for 1 hr at 4° C. at 10,000 g. The supernatant was applied to 5 mL of StrepTactin Sepharose (GE) and incubated with rotation for 1 hr followed by washing of the protein-bound StrepTactin resin three times in lysis buffer. The resin was resuspended in SUMO digest buffer (30 mM Tris-HCl, 500 mM NaCl 1 mM DTT, 0.15% Igepal (NP-40), pH 8.0) along with 250 Units of SUMO protease (250 mg/ml) and incubated overnight at 4° C. with rotation. The suspension was applied to a column for elution and separation from resin by gravity flow. The resin was washed two times with 1 column volume of Lysis buffer to maximize protein elution. The elute was diluted in cation exchange buffer (20 mM HEPES, 1 mM DTT, 5% glycerol, pH 7.0; pH 7.5 for LbuCas13a, LbaCas13a, EiCsm6, LsCsm6, TtCsm6) to lower the salt concentration in preparation for cation exchange chromatography to 250 mM.

For cation exchange and gel filtration purification, protein was loaded onto a 5 mL HiTrap SP HP cation exchange column (GE Healthcare Life Sciences) via FPLC (AKTA PURE)

GE Healthcare Life Sciences) and eluted over a salt gradient from 250 mM to 2M NaCl in elution buffer (20 mM HEPES, 1 mM DTT, 5% glycerol, pH 7.0; pH 7.5 for LbuCas13a, LbaCas13a). The resulting fractions were tested for presence of recombinant protein by SDS-PAGE, and fractions containing the protein were pooled and concentrated via a Centrifugal Filter Unit (Millipore 50MWCO) to 1 mL in S200 buffer (10 mM HEPES, 1 M NaCl, 5 mM MgCl2, 2 mM DTT, pH 7.0). The concentrated protein was loaded onto a gel filtration column (Superdex® 200 Increase 10/300 GL, GE Healthcare Life Sciences) via FPLC. The resulting fractions from gel filtration were analyzed by SDS-PAGE and fractions containing protein were pooled and buffer exchanged into Storage Buffer (600 mM NaCl, 50 mM Tris-HCl pH 7.5, 5% glycerol, 2 mM DTT) and frozen at −80° C. for storage.

Accession numbers and plasmid maps for all proteins purified in this study are available in Table 22.

Nucleic Acid Target and crRNA Preparation

Nucleic acid targets for Cas12a and genomic DNA detection were PCR amplified with NEBNext PCR master mix, gel extracted, and purified using MinElute gel extraction kit (Qiagen). For RNA based detection, purified dsDNA was incubated with T7 polymerase overnight at 30° C. using the HiScribe T7 Quick High Yield RNA Synthesis kit (New England Biolabs) and RNA was purified with the MEGAclear Transcription Clean-up kit (Thermo Fisher)

crRNA preparation was carried out as described before (3) with minor modifications and is detailed below. For preparation of crRNAs, constructs were ordered as ultramer DNA (Integrated DNA Technologies) with an appended T7 promoter sequence. crRNA DNA was annealed to a short T7 primer (final concentrations 10 uM) and incubated with T7 polymerase overnight at 37° C. using the HiScribe T7 Quick High Yield RNA Synthesis kit (New England Biolabs). crRNAs were purified using RNAXP clean beads (Beckman Coulter) at 2× ratio of beads to reaction volume, with an additional 1.8× supplementation of isopropanol (Sigma).

All crRNA sequences used in this study are available in Table 23. Table 23 lists SEQ ID NO:453-827, with SEQ ID NO:453 representing the complete crRNA sequence, SEQ ID NO:454 representing the spacer, and SEQ ID NO:455 representing the direct repeat for LwaCas13a. The remaining sequence identifiers in the table follow the same pattern. All DNA and RNA target sequences used in this study are available in Table 24.

Primers for RPA were designed using NCBI Primer-BLAST (27) using default parameters, with the exception of amplicon size (between 100 and 140 nt), primer melting temperatures (between 54° C. and 67° C.), and primer size (between 30 and 35 nt). Primers were then ordered as DNA (Integrated DNA Technologies).

RPA and RT-RPA reactions run were as instructed with TwistAmp® Basic or TwistAmp® Basic RT (TwistDx), respectively, with the exception that 280 mM MgAc was added prior to the input template. Reactions were run with 1 µL of input for 1 hr at 37° C., unless otherwise described.

For SHERLOCK quantification of nucleic acid, RPA primer concentration tested at standard concentration (480 nM final) and lower (240 nM, 120 nM, 60 nM, 24 nM) to find the optimum concentration. RPA reactions were further run for 20 minutes.

When multiple targets were amplified with RPA, primer concentration was adjusted to a final concentration of 480 nM. That is, 120 nM of each primer for two primer pairs were added for duplex detection.

All RPA primers used in this study are available in Table 25. Shown are SEQ ID NO:841-870, with SEQ ID NO:841 representing the forward primer sequence, SEQ ID NO:842 representing the forward primer sequence with T7 RNAP promoter, and SEQ ID NO:843 representing the reverse primer sequence for DENV ssRNA. The remaining sequence identifiers follow the same pattern.

Fluorescent Cleavage Assay

Detection assays were carried out as described before (3) with minor modifications and the procedure is detailed below. Detection assays were performed with 45 nM purified Cas13, 22.5 nM crRNA, quenched fluorescent RNA reporter (125 nM RNAse Alert v2, Thermo Scientific, homopolymer and di-nucleotide reporters (IDT); 250 nM for polyA Trilink reporter), 0.5 µL murine RNase inhibitor (New England Biolabs), 25 ng of background total human RNA (purified from HEK293FT culture), and varying amounts of input nucleic acid target, unless otherwise indicated, in nuclease assay buffer (20 mM HEPES, 60 mM NaCl, 6 mM MgCl2, pH 6.8). For Csm6 fluorescent cleavage reactions, protein was used at 1 OnM final concentration along with 500 nM of 2', 3' cyclic phosphate oligoadenylate, 250 nM of fluorescent reporter, and 0.5 µL murine RNase inhibitor in nuclease assay buffer (20 mM HEPES, 60 mM NaCl, 6 mM MgCl2, pH 6.8). Reactions were allowed to proceed for 1-3 hr at 37° C. (unless otherwise indicated) on a fluorescent plate reader (BioTek) with fluorescent kinetics measured every 5 min. In reactions involving AsCas12a, 45 nM AsCas12a was included using recombinant protein from IDT. In the case of multiplexed reactions, 45 nM of each protein and 22.5 nM of each crRNA was used in the reaction.

All cleavage reporters used in this study are available in Table 26. Shown are SEQ ID NO:871-877, representing sequences of 10 nucleotides in length, or longer. Sequences shorter than 10 nucleotides were not assigned sequence identifiers.

SHERLOCK Nucleic Acid Detection

Detection assays were performed with 45 nM purified Cas13, 22.5 nM crRNA, quenched fluorescent RNA reporter (125 nM RNAse Alert v2, Thermo Scientific, homopolymer and di-nucleotide reporters (IDT), 250 nM for polyA Trilink reporter), 0.5 µL murine RNase inhibitor (New England Biolabs), 25 ng of background total human RNA (purified from HEK293FT culture), and 1uL of RPA reaction in nuclease assay buffer (20 mM HEPES, 60 mM NaCl, 6 mM MgCl2, pH 6.8), rNTP mix (1 mM final, NEB), 0.6 µL T7 polymerase (Lucigen) and 3 mM MgCl2. Reactions were allowed to proceed for 1-3 hr at 37° C. (unless otherwise indicated) on a fluorescent plate reader (BioTek) with fluorescent kinetics measured every 5 min.

For one-pot nucleic acid detection, the detection assay was carried out as described before (3) with minor modifications. A single 100 µL combined reaction assay consisted of 0.48 µM forward primer, 0.48 µM reverse primer, 1x RPA rehydration buffer, varying amounts of DNA input, 45 nM LwCas13a recombinant protein, 22.5 nM crRNA, 125 ng background total human RNA, 125 nM substrate reporter (RNase alert v2), 2.5 µL murine RNase inhibitor (New England Biolabs), 2 mM ATP, 2 mM GTP, 2 mM UTP, 2 mM CTP, 1 µL T7 polymerase mix (Lucigen), 5 mM MgCl2, and 14 mM MgAc. Reactions were allowed to proceed for 1-3 hr at 37° C. (unless otherwise indicated) on a fluorescent plate reader (BioTek) with fluorescent kinetics measured every 5 min. For lateral flow readout, 20 uL of the combined reaction was added to 100 uL of HybriDetect 1 assay buffer (Milenia) and run on HybriDetect 1 lateral flow strips (Milenia).

Nucleic Acid Labeling for Cleavage Fragment Analysis

Target RNA was in vitro transcribed from a dsDNA template and purified as described above. The in vitro cleavage reaction was performed as described above for fluorescence cleavage reaction with the following modifications. Fluorescence reporter was substituted for 1 µg RNA target and no background RNA was used. Cleavage reaction was carried out for 5 minutes (LwaCas13a) or 1 hour (PsmCas13b) at 37° C. The cleavage reaction was purified using the RNA clean & concentrator-5 kit (Zymo Research) and eluted in 10 uL UltraPure water (Gibco). Cleavage reaction was further labeled with a 10 µg of maleimide IRDye 800CW (Licor) following the 5'EndTag labeling Reaction (Vector Laboratories) kit protocol. To determine the 5' end produced by Cas13 cleavage, the protocol was modified to either perform an Alkaline Phosphatase (AP) treatment or substitute with UltraPure water to only label 5'-OH containing RNA species, while undigested triphosphorylated (PPP) RNA species are only labeled when AP treatment is performed.

Mass Spectrometry for High Resolution Cleavage Fragment Analysis

For determining the cleavage ends produced by Cas13 collateral RNase activity by Mass Spectrometry, an in vitro cleavage reaction was performed as described above with the following modifications. Cas13 RNA target was used at 1 nM final concentration, Csm6 activator at 3 µM final concentration and no background RNA was used. For control reactions, either Cas13 target was substituted by Ultra-Pure water, or standard in vitro cleavage reaction was incubated with hexaadenylate containing a 2', 3' cyclic phosphate activator in the absence of Cas13 target, Cas13 protein and Cas13 crRNA. The cleavage reactions were carried out for 1 h at 37° C. and purified using an New England Biolabs siRNA purification protocol. In brief, one-tenth volume of 3 M NaOAc, 2 µL of RNase-free Glycoblue (Thermofisher) and three volumes of cold 95% ethanol was added, placed at −20° C. for 2 hours, and centrifuged for 15 minutes at 14,000 g. The supernatant was removed and two volumes of 80% EtOH was added and incubated for 10 minutes at room temperature. The supernatant was decanted and samples centrifuged for 5 minutes at 14,000 g. After air-drying the pellet, 50 µL of UltraGrade water added and sent on dry ice for Mass spectrometry analysis.

For mass spectrometry analysis, samples were diluted 1:1 with UltraGrade water and analyzed on Bruker Impact II q-TOF mass spectrometer in negative ion mode coupled to an Agilent 1290 HPLC. 10 µL were injected onto a PLRP-S column (50 mm, 5 um particle size, 1000 angstrom pore size PLRP-S column, 2.1 mm ID) using 0.1% ammonium hydroxide v/v in water as mobile phase A and acetonitrile as mobile phase B. The flow rate was kept constant throughout at 0.3 ml/minute. The mobile phase composition started at 0% B and was maintained for the first 2 minutes. After this point, the composition was changed to 100% B over the next 8 minutes and maintained for one minute. The composition was then returned to 0% B over 0.1 minute and then maintained for the following 4.9 minutes to allow the column to re-equilibrate to starting conditions. The mass spectrometer was tuned for large MW ions, and data was acquired between m/z 400-5000. The entire dataset from the mass spectrometer was calibrated by m/z using an injection of sodium formate. Data was analyzed using Bruker Compass Data Analysis 4.3 with a license for MaxEnt deconvolution algorithm to generate a calculated neutral mass spectrum from the negatively charged ion data.

Genomic DNA Extraction from Human Saliva

Saliva DNA extraction was carried out as described before (3) with minor modifications and is detailed below. 2 mL of saliva was collected from volunteers, who were restricted from consuming food or drink 30 min prior to collection. Samples were then processed using QIAamp® DNA Blood Mini Kit (Qiagen) as recommended by the kit protocol. For boiled saliva samples, 400 µL of phosphate buffered saline (Sigma) was added to 100 µL of volunteer saliva and centrifuged for 5 min at 1800 g. The supernatant was decanted and the pellet was resuspended in phosphate buffered saline with 0.2% Triton X-100 (Sigma) before incubation at 95° C. for 5 min. 1 µL of sample was used as direct input into RPA reactions.

Digital Droplet PCR Quantification ddPCR quantification was carried out as described before (3) with minor modifications and is detailed below. To confirm the concentration of target dilutions, we performed digital-droplet PCR (ddPCR). For DNA quantification, droplets were made using the ddPCR Supermix for Probes (no dUTP) (BioRad) with PrimeTime qPCR probes/primer assays (IDT) designed for the target sequence. For RNA quantification, droplets were made using the one-step RT-ddPCR kit for probes with PrimeTime qPCR probes/primer assays designed for the target sequence. Droplets were generated in either case using the QX200 droplet generator (BioRad) and transferred to a PCR plate. Droplet-based amplification was performed on a thermocycler as described in the kit protocol and nucleic acid concentrations were subsequently determined via measurement on a QX200 droplet reader.

Cas13-Csm6 Fluorescent Cleavage Assay

Cas13-Csm6 combined fluorescent cleavage assays were performed as described for standard Cas13 fluorescent cleavage reactions with the following modifications. Csm6 protein was added to 10 nM final concentration, 400 nM of Csm6 fluorescent reporter and 500 nM Csm6 activator unless otherwise indicated. For distinguishing Cas13 from Csm6 collateral RNase activity, two distinct fluorophores were used for fluorescence detection (FAM and HEX). Because of the interference of rNTPs with Csm6 activity, the IVT was performed in the RPA pre-amplification step and then 10 µL of this reaction was added as input to the Cas13-Csm6 cleavage assay.

In the case where we tested a three-step Cas13-Csm6 cleavage assay, the RPA was performed normally as discussed above for varying times and then used as input to a normal IVT reaction for varying times. Then 10 µL of the IVT was used as input to the Cas13-Csm6 reaction described in the previous paragraph. All Csm6 activators used in this study are available in Table 27.

Motif Discovery Screen with Library

To screen for Cas13 cleavage preference, an in vitro RNA cleavage reaction was set up as described above with the following modifications. Cas13 target was used at 20 nM, fluorescent reporter was substituted for 1 µM of DNA-RNA oligonucleotide (IDT) that contains a 6-mer stretch of randomized ribonucleotides flanked by DNA handles for NGS library preparation. Reactions were carried out for 60 minutes (unless otherwise indicated) at 37° C. The reactions were purified using the Zymo oligo-clean and concentrator-5 kit (Zymo research) and 15 µL of UltraPure water was used for elution. 10 µL of purified reaction was used for reverse transcription using a gene-specific primer that binds to the DNA handle.

Reverse transcription (RT) was carried out for 45 minutes at 42° C. according to the qScript Flex cDNA-kit (quantabio) protocol. To assess cleavage efficiency and product purity, RT-reactions were diluted 1:10 in water and loaded on a Small RNA kit and run on a Bioanalyzer 2100 (Agilent). Four microliters of RT-reaction was used for the first-round of NGS library preparation. NEBNext (NEB) was used to amplify first strand cDNA with a mix of forward primers at 625 nM final and a reverse primer at 625 nM for 15 cycles with 3 minute initial denaturation at 98° C., 10 s cycle denaturation at 98° C., 10 s annealing at 63° C., 20 s 72° C. extension and 2 minute final extension extension at 72° C.

Two microliters of first round PCR reaction was used for second round PCR amplification to attach Illumina-compatible indices (NEB) for NGS sequencing. The same NEBNext PCR protocol was used for amplification. PCR product were analysed by agarose gel-electrophoresis (2% Sybr Gold E-Gel Invitrogen system) and 5 µL of each reaction was pooled. The pooled samples was gel extracted, quantified with Qubit DNA 2.0 DNA High sensitivity kit and normalized to 4 nM final concentration. The final library was diluted to 2 pM and sequenced on a NextSeq 500 Illumina system using a 75-cycle kit.

Motif Screen Analysis

To analyze depletion of preferred motifs from the random motif library screen, 6-mer regions were extracted from sequence data and normalized to overall read count for each sample. Normalized read counts were then used to generated log ratios, with psuedocount adjustment, between experimental conditions and matched controls. For Cas13 experiments, matched controls did not have target RNA added; for Csm6 and RNase A experiments, matched controls did not have enzyme. Log ratio distribution shape was used to determine cut-offs for enriched motifs. Enriched motifs were then used to determine occurrence of 1-, 2-, or 3-nucleotide combinations. Motif logos were generated using Weblogo3 (26).

Phylogenetic Analysis of Cas13 Protein and crRNA Direct Repeats

To study ortholog clustering, multiple sequence alignments were generated with Cas13a and Cas13b protein sequences in Geneious with MUSCLE and then clustered using Euclidean distance in R with the heatmap.2 function. To study direct repeat clustering, multiple sequence alignments were generated with Cas13a and Cas13b direct repeat sequences in Geneious using the Geneious algorithm and then clustered using Euclidean distance in R with the heatmap.2 function. To study clustering of orthologs based on di-nucleotide motif preference, the cleavage activity matrix was clustered using Euclidean distance in R using the heatmap.2 function.

Gold Nanoparticle Colorimetric

An RNA oligo was synthesized from IDT with thiols at the 5' and 3' ends (Table 26 for sequence). In order to deprotect the thiol groups, the oligo at a final concentration of 20 mM was reduced in 150 mM sodium phosphate buffer containing 100 mM DTT for 2 hours at room temperature. The oligo were then purified using sephadex NAP-5 columns (GE Healthcare) into a final volume of 700 µL water. As previously described (20), the reduced oligo at 10 µM was added at a volume of 280 µL to 600 µL of 2.32 nM 15 nm-gold nanoparticles (Ted Pella), which is a 2000:1 ratio of oligo to nanoparticles. Subsequently, 10 µL of 1M Tris-HCl at pH8.3 and 90 µL of 1M NaCl were added to the oligo-nanoparticle mixture and incubated for 18 hours at room temperature with rotation. After 18 hours, additional 1M Tris-HCl (5 µL at pH8.3) was added with 5M NaCl (50 µL) and this was incubated for an additional 15 hours at room temperature with rotation. Following incubation, the final solution was centrifuged for 25 min at 22,000 g. The supernatant was discarded and the conjugated nanoparticles were resuspended in 50 µL of 200 mM NaCl.

The nanoparticles were tested for RNase sensitivity using an RNase A assay. Varying amounts of RNase A (Thermo Fischer) were added to 1× RNase A buffer and 6 µL of conjugated nanoparticles in a total reaction volume of 20 µL. Absorbance at 520 nm was monitored every 5 minutes for 3 hours using a plate spectrophotometer.

Lateral Flow Readout of Cas13 Activity Using FAM-Biotin Reporters

For lateral flow based on cleavage of a FAM-RNA-biotin reporter, non-RPA LwaCas13a reactions or SHERLOCK-LwaCas13a reactions were run for 1 hour, unless otherwise indicated, with 1 uM final concentration of FAM-RNA-biotin reporter. After incubation, 20 uL LwaCas13a reactions supernatant was added to 100 uL of HybriDetect 1 assay buffer (Milenia) and run on HybriDetect 1 lateral flow strips (Milenia).

Cloning of REPAIR Constructs, Mammalian Cell Transfection, RNA Isolation and NGS Library Preparation for REPAIR Constructs for simulating reversion of APC mutations and guide constructs for REPAIR were cloned as previously described (23). Briefly, 96 nt sequences centered on the APC:c.1262G>A mutation were designed and golden gate cloned under an expression vector, and corresponding guide sequences were golden gate cloned into U6 expression vectors for PspCas13b guides. To simulate patient samples, 300 ng of either mutant or wildtype APC expression vector was transfected into HEK293FT cells with Lipofectamine 2000 (Invitrogen), and two days post-transfection DNA was harvested with Qiamp DNA Blood Midi Kit (Qiagen) following manufacturer's instructions. 20 ng of DNA were used as input into SHERLOCK-LwaCas13a reactions.

RNA correction using the REPAIR system was performed as previously described (23): 150 ng of dPspCas13b-ADAR (DD)E488Q, 200 ng of guide vector, and 30 ng of APC expression vector were co-transfected, and two-days post transfection RNA was harvested using the RNeasy Plus Mini Kit (Qiagen) following manufacturer's instructions. 30 ng of RNA was used as input into SHERLOCK-LwaCas13a reactions. All plasmids used for REPAIR RNA editing in this study are available in Table 29.

RNA editing fractions were independently determined by NGS as previously described. RNA was reverse transcribed with the qScript Flex kit (Quanta Biosciences) with a sequence specific primer. First strand cDNA was amplified with NEBNext High Fidelity 2×PCR Mastermix (New England Biosciences) with a mix of forward primers at 625 nM final and a reverse primer at 625 nM for 15 cycles with 3 minute initial denaturation at 98° C., 10 second cycle denaturation at 98° C., 30 second annealing at 65° C., 30 second 72° C. extension and 2 minute final extension at 72° C. Two microliters of first round PCR reaction was used for second round PCR amplification to attach Illumina-compatible indices for NGS sequencing, with NEBNext, using the same protocol with 18 cycles. PCR products were analysed by agarose gel-electrophoresis (2% Sybr Gold E-Gel Invitrogen) and 5 μL of each reaction was pooled. The pooled samples was gel extracted, quantified with Qubit DNA 2.0 DNA High sensitivity kit and normalized to 4 nM final concentration, and read out with a 300 cycle v2 MiSeq kit (Illumina).

Analysis of SHERLOCK Fluorescence Data

SHERLOCK fluorescence analysis was carried out as described before (3) with minor modifications and is detailed below. To calculate background subtracted fluorescence data, the initial fluorescence of samples was subtracted to allow for comparisons between different conditions. Fluorescence for background conditions (either no input or no crRNA conditions) were subtracted from samples to generate background subtracted fluorescence.

crRNA ratios for SNP discrimination were calculated to adjust for sample-to-sample overall variation as follows:

$$\text{crRNA } A_i \text{ ratio} = \frac{(m+n)A_i}{\sum_{i=1}^{m} A_i + \sum_{i=1}^{n} B_i}$$

where $A_i$ and $B_i$ refer to the SHERLOCK intensity values for technical replicate i of the crRNAs sensing allele A or allele B, respectively, for a given individual. Since we typically have four technical replicates per crRNA, m and n are equal to 4 and the denominator is equivalent to the sum of all eight of the crRNA SHERLOCK intensity values for a given SNP locus and individual. Because there are two crRNAs, the crRNA ratio average across each of the crRNAs for an individual will always sum to two. Therefore, in the ideal case of homozygosity, the mean crRNA ratio for the positive allele crRNA will be two and the mean crRNA ratio for the negative allele crRNA will be zero. In the ideal case of heterozygosity, the mean crRNA ratio for each of the two crRNAs will be one. Because in SHERLOCKv2, we accomplish genotyping by measuring A, and $B_1$ in different color channels, we scaled the 530-color channel by 6 to match the intensity values in the 480-color channel.

Promiscuous Cleavage of Cas13 Orthologs in Absence of Target

Some members of the Cas13 family, such as PinCas13b and LbuCas13a, demonstrate promiscuous cleavage in the presence or absence of target, and this background activity is di-nucleotide reporter dependent (FIG. 101). This background activity was also spacer dependent for LbuCas13a. In some reporters, the U and A base preference clustered within protein or DR similarity. Interestingly, di-nucleotide preferences identified here did not correspond with Cas13 families clustered from either direct repeat similarity or protein similarity (FIG. 101).

Characterization of crRNA Designs for PsmCas13b and CcaCas13b

To identify the optimal crRNA for detection with PsmCas13b and CcaCas13b, we tested crRNA spacer lengths from 34-12 nt and found that PsmCas13b had a peak sensitivity at a spacer length of 30, whereas CcaCas13b had equivalent sensitivity above spacer lengths of 28 nt, justifying the use of 30 nt spacers for evaluating Cas13 activity To further explore the robustness of targeting of CcaCas13b and PsmCas13b compared to LwaCas13a, we designed eleven different crRNAs evenly spaced across ssRNA 1 and found that LwaCas13a collateral activity was robust to crRNA design, while CcaCas13b and PsmCas13b both showed more variability in activity across different crRNAs.

Random library motif screening for additional orthogonal motifs To further explore the diversity of cleavage preferences of Cas13a and Cas13b orthologs, we developed a library-based approach for characterizing preferred motifs for collateral endonuclease activity. We used a degenerate 6-mer RNA reporter flanked by constant DNA handles, which allowed for amplification and readout of uncleaved sequences. Incubating this library with Cas13 enzymes resulted in detectable cleavage patterns that depended on the addition of target RNA (FIG. S12B), and sequencing of depleted motifs from these reactions revealed an increase in the skew of the library over digestion time, indicative of a population of preferred motifs for cleavage. Sequence logos and pairwise base preferences from highly depleted motifs reproduced the U-preference observed for LwaCas13a and CcaCas13b and the A-preference of PsmCas13b. We synthesized reporters from top motifs as determined from the screen to validate the findings, and found that LwaCas13a, CcaCas13a, and PsmCas13b all cleaved their most highly preferred motif. We also found multiple sequences that showed cleavage for only one ortholog, but not others, which could allow for an alternative orthogonal readout from di-nucleotide motifs. LwaCas13a incubated with different targets produced similar cleavage motif preferences, indicating that the base preference of the collateral activity is constant regardless of target sequence.

Validation of Activator Products Upon LwaCas13a Cleavage

Using mass spectrometry, we verified that LwaCas13a digestion produced the expected cyclic-phosphate terminated products for Csm6 activation. Activation was most effective for designs with 3' protection with poly U, as other activation designs, including 5' protection with poly-U and internal poly-U tracts, were less effective at activating Csm6 exclusively in the presence of target RNA, likely because LwaCas13a has little activity on UA motifs and 5' protection is ineffective at preventing activation of Csm6.

Optimization for Combining RPA and Csm6 Reactions

As combining Csm6-enhancement with RPA pre-amplification would increase signal and sensitivity, we tested Csm6 for activity in the presence of in vitro transcription components necessary for combination with RPA. We found that both magnesium and free rNTP reduced the nuclease activity of Csm6 in the presence of a cyclic phosphate activator (FIG. S33A). Reducing the amount of rNTP in solution reduced the amount of transcribed RNA, and therefore had a negative effect on Csm6 activation by Cas13a even in the presence of increased reporter or activator concentrations.

TABLE 22

| | | | | |
|---|---|---|---|---|
| Cas13 and Csm6 proteins purified in this study. | | | | |
| Abbreviation | Protein name | Strain name | Benchling link | Accession number |
| Lwa | LwaCas13a | *Leptotrichia wadei* | https://benchling.com/s/seq-66CfLwu7sLMQMbcXe7lh | WP_021746774.1 |
| Lba | LbaCas13a | *Lachnospiraceae bacterium* NK4A179 | https://benchling.com/s/seq-xdOysFgbmgAsTRoTiERc | WP_022785443.1 |
| Lbu | LbuCas13a | *Leptotrichia buccalis* C-1013-b | https://benchling.com/s/seq-e0aUn6uEVvWXntoggf60 | WP_015770004.1 |
| Bzo | BzoCas13b | *Bergeyella zoohelcum* | https://benchling.com/s/seq-mA3sJ4Gli4x0JB5q7KHK | WP_002664492 |
| Pin | PinCas13b | *Prevotella intermedia* | https://benchling.com/s/seq-iA58bdz9mHOZmbFLj92f | WP_036860899 |
| Pbu | PbuCas13b | *Prevotella buccae* | https://benchling.com/s/seq-nNv4KSgZDFtdPX88zSS2 | WP_004343973 |
| Asp | AspCas13b | *Alistipes* sp. ZOR0009 | https://benchling.com/s/seq-lHs6D7J5Z2NkCbbkggek | WP_047447901 |
| Psm | PsmCas13b | *Prevotella* sp. MA2016 | https://benchling.com/s/seq-v7Q1TzaZzAyNZIGKNnH3 | WP_036929175 |
| Ran | RanCas13b | *Riemerella anatipestifer* | https://benchling.com/s/seq-HlhclUZszBOQAdW5rlmW | WP_004919755 |
| Pau | PauCas13b | *Prevotella aurantiaca* | https://benchling.com/s/seq-Se9MuspJQek3x4vvR1BF | WP_025000926 |
| Psa | PsaCas13b | *Prevotella saccharolytica* | https://benchling.com/s/seq-NXtrOPLbhpyc9nZk1seg | WP_051522484 |
| Pin2 | Pin2Cas13b | *Prevotella intermedia* | https://benchling.com/s/seq-mSXhS57arjPDuvnQjZOn | WP_061868553 |
| Cca | CcaCas13b | *Capnocytophaga canimorsus* | https://benchling.com/s/seq-BNVzFUQjqSnkYLARxLwE | WP_013997271 |
| Pgu | PguCas13b | *Porphyromonas gulae* | https://benchling.com/s/seq-GVOv8zBVlta2utHyuTSR | WP_039434803 |
| Psp | PspCas13b | *Prevotella* sp. P5-125 | https://benchling.com/s/seq-XmnWQgXrpvVAwXoNtJGw | WP_044065294 |
| Pig | PigCas13b | *Porphyromona gingivalis* | https://benchling.com/s/seq-hxdDNJtJmA5axRvcxm0p | WP_053444417 |
| Pin3 | Pin3Cas13b | *Prevotella intermedia* | https://benchling.com/s/seq-GlaCfl5cDw4sKXz6LM11 | WP_050955369 |
| Ei | EiCsm6 | *Enterococcus italicus* | https://benchling.com/s/seq-YrP8xiVG3rBwxYMgCUH0 | WP_007208953.1 |
| Ls | LsCsm6 | *Lactobacillus salivarius* | https://benchling.com/s/seq-duuAaForfhsBc53zLY5z | WP_081509150.1 |
| Tt | TtCsm6 | *Thermus thermophilus* | https://benchling.com/s/seq-esibVH1rmHPjHYXxKWja | WP_011229148.1 |

TABLE 23 crRNA used in this study (SEQ ID NO: 453-827).

| Name | Ortholog | Complete crRNA sequence | Spacer | Direct repeat | Target |
|---|---|---|---|---|---|
| ssRNA/ssDNA 1 crRNA 2 | LwaCas13a | GATTTAGACTACCCCAAAA ACGAAGGGGACTAAAACCT ACCAAGTAATCCATATTTC TAGAGGATC | CTACCAAG TAATCCAT ATTTCTAG AGGATC | GATTTAGACTAC CCCAAAAACGAA GGGGACTAAAAC | ssRNA 1 |
| BzoCas13b ssRNA/ssDNA crRNA 2 | BzoCas13b | CTACCAAGTAATCCATATT TCTAGAGGATCGTTGGAAC TGCTCTCATTTTGGAGGGT AATCACAAC | CTACCAAG TAATCCAT ATTTCTAG AGGATC | GTTGGAACTGCT CTCATTTTGGAG GGTAATCACAAC | ssRNA 1 |
| PinCas13b ssRNA/ssDNA crRNA 2 | PinCas13b | CTACCAAGTAATCCATATT TCTAGAGGATCGTTGCATC TGCCTGCTGTTTGCAAGGT AAAAACAAC | CTACCAAG TAATCCAT ATTTCTAG AGGATC | GTTGCATCTGCC TGCTGTTTGCAA GGTAAAAACAAC | ssRNA 1 |
| PbuCas13b ssRNA/ssDNA crRNA 2 | PbuCas13b | CTACCAAGTAATCCATATT TCTAGAGGATCGTTGCATC TGCCTTCTTTTTGAAAGGT AAAAACAAC | CTACCAAG TAATCCAT ATTTCTAG AGGATC | GTTGCATCTGCC TTCTTTTTGAAA GGTAAAAACAAC | ssRNA 1 |
| AspCas13b ssRNA/ssDNA crRNA 2 P | AspCas13b | CTACCAAGTAATCCATATT TCTAGAGGATCGCTGTTAT ATCCTTACCTTTGTAAGGG AAGTACAGC | CTACCAAG TAATCCAT ATTTCTAG AGGATC | GCTGTTATATCC TTACCTTTGTAA GGGAAGTACAGC | ssRNA 1 |
| smCas13b ssRNA/ssDNA crRNA 2 | PsmCas13b | CTACCAAGTAATCCATATT TCTAGAGGATCGTTGTAGA AGCTTATCGTTTGGATAGG TATGACAAC | CTACCAAG TAATCCAT ATTTCTAG AGGATC | GTTGTAGAAGCT TATCGTTTGGAT AGGTATGACAAC | ssRNA 1 |
| RanCas13b ssRNA/ssDNA crRNA 2 | RanCas13b | CTACCAAGTAATCCATATT TCTAGAGGATCGTTGGGAC TGCTCTCACTTTGAAGGGT ATTCACAAC | CTACCAAG TAATCCAT ATTTCTAG AGGATC | GTTGGGACTGCT CTCACTTTGAAG GGTATTCACAAC | ssRNA 1 |
| PauCas13b ssRNA/ssDNA crRNA 2 | PauCas13b | CTACCAAGTAATCCATATT TCTAGAGGATCGTTGTATC TGCCTTCTGTTTGAAAGGT AAAAACAAC | CTACCAAG TAATCCAT ATTTCTAG AGGATC | GTTGTATCTGCC TTCTGTTTGAAA GGTAAAAACAAC | ssRNA 1 |
| PsaCas13b ssRNA/ssDNA crRNA 2 | PsaCas13b | CTACCAAGTAATCCATATT TCTAGAGGATCGTTGTGTC TACCTCCTTTTTGAGAGGT AAAAACAGC | CTACCAAG TAATCCAT ATTTCTAG AGGATC | GTTGTGTCTACC TCCTTTTTGAGA GGTAAAAACAGC | ssRNA 1 |
| Pin2Cas13b ssRNA/ssDNA crRNA 2 | Pin2Cas13b | CTACCAAGTAATCCATATT TCTAGAGGATCGTTGCATC TGCCTGCTGTTTGCAAGGT AAAAACAAC | CTACCAAG TAATCCAT ATTTCTAG AGGATC | GTTGCATCTGCC TGCTGTTTGCAA GGTAAAAACAAC | ssRNA 1 |
| CcaCas13b ssRNA/ssDNA crRNA 2 | CcaCas13b | CTACCAAGTAATCCATATT TCTAGAGGATCGTTGGAAC TGCTCTCATTTTGGAGGGT AATCACAAC | CTACCAAG TAATCCAT ATTTCTAG AGGATC | GTTGGAACTGCT CTCATTTTGGAG GGTAATCACAAC | ssRNA 1 |
| PguCas13b ssRNA/ssDNA crRNA 2 | PguCas13b | CTACCAAGTAATCCATATT TCTAGAGGATCGTTGGATC TACCCTCTATTTGAAGGGT ACACACAAC | CTACCAAG TAATCCAT ATTTCTAG AGGATC | GTTGGATCTACC CTCTATTTGAAG GGTACACACAAC | ssRNA 1 |
| PspCas13b ssRNA/ssDNA crRNA 2 | PspCas13b | CTACCAAGTAATCCATATT TCTAGAGGATCGTTGTGGA AGGTCCAGTTTTGAGGGGC TATTACAAC | CTACCAAG TAATCCAT ATTTCTAG AGGATC | GTTGTGGAAGGT CCAGTTTTGAGG GGCTATTACAAC | ssRNA 1 |
| PigCas13b ssRNA/ssDNA crRNA 2 | PigCas13b | CTACCAAGTAATCCATATT TCTAGAGGATCGTTGGATC TACCCTCTATTCGAAGGGT ACACACAAC | CTACCAAG TAATCCAT ATTTCTAG AGGATC | GTTGGATCTACC CTCTATTCGAAG GGTACACACAAC | ssRNA 1 |
| Pin3Cas13b ssRNA/ssDNA crRNA 2 | Pin3Cas13b | CTACCAAGTAATCCATATT TCTAGAGGATCGTTGCATC TGCCTGCTGTTTGCAAGGT AAAAACAAC | CTACCAAG TAATCCAT ATTTCTAG AGGATC | GTTGCATCTGCC TGCTGTTTGCAA GGTAAAAACAAC | ssRNA 1 |

TABLE 23-continued crRNA used in this study (SEQ ID NO: 453-827).

| Name | Ortholog | Complete crRNA sequence | Spacer | Direct repeat | Target |
|---|---|---|---|---|---|
| DENV crRNA LwaCas13a | LwaCas13a | GATTTAGACTACCCCAAAA ACGAAGGGGACTAAAACTG CTTCTGTCCAGTGAGCATG GTCTTCG | TGCTTCTG TCCAGTGA GCATGGTC TTCG | GATTTAGACTAC CCCAAAAACGAA GGGGACTAAAAC | DENV ssRNA |
| DENV crRNA PsmCas13b | PsmCas13b | TTTGCTTCTGTCCAGTGAG CATGGTCTTCGGTTGTAGA AGCTTATCGTTTGGATAGG TATGACAAC | TTTGCTTC GTTGTAGAAGCT TGTCCAGT TATCGTTTGGAT GAGCATGG AGGTATGACAAC TCTTCG | | DENV ssRNA |
| ssDNA 1 crRNA Cas12a | AsCas12a | TAATTTCTACTCTTGTAGA TCTGTGTTTATCCGCTCAC AA | CTGTGTTT TAATTTCTACTC ATCCGCTC TTGTAGAT ACAA | | ssDNA 1 |
| Thermonuclease crRNA PsmCas13b | PsmCas13b | ATGCTTTGTTTCAGGTGTA TCAACCAATAAGTTGTAGA AGCTTATCGTTTGGATAGG TATGACAAC | ATGCTTTG GTTGTAGAAGCT TTTCAGGT TATCGTTTGGAT GTATCAAC AGGTATGACAAC CAATAA | | Thermo- nuclease ssDNA |
| Acyltransferase LwaCas13a crRNA | LwaCas13a | GATTTAGACTACCCCAAAA ACGAAGGGGACTAAAACAG CACGCTCACCCGCGGGTTG CCTTCGG | AGCACGCT GATTTAGACTAC CACCCGCG CCCAAAAACGAA GGTTGCCT GGGGACTAAAAC TCGG | | Acyltrans ferase ssDNA |
| ZIKV LwaCas13a crRNA | LwaCas13a | GATTTAGACTACCCCAAAA ACGAAGGGGACTAAAACAC TCCCTAGAACCACGACAGT TTGCCTT | ACTCCCTA GATTTAGACTAC GAACCACG CCCAAAAACGAA ACAGTTTG GGGGACTAAAAC CCTT | | ZIKV ssRNA |
| EGFR L858R wild-type sensing crRNA | LwaCas13a | GATTTAGACTACCCCAAAA ACGAAGGGGACTAAAACCC AGGCCAAAATCTGTGATCT TGACATG | CCAGGCCA GATTTAGACTAC AAATCTGT CCCAAAAACGAA GATCTTGA GGGGACTAAAAC CATG | | EGFR L858L WT |
| EGFR L858R mutant sensing crRNA | LwaCas13a | GATTTAGACTACCCCAAAA ACGAAGGGGACTAAAACCC CGGCCAAAATCTGTGATCT TGACATG | CCCGGCCA GATTTAGACTAC AAATCTGT CCCAAAAACGAA GATCTTGA GGGGACTAAAAC CATG | | EGFR L858R mutation |
| Exon 19 deletion mutant sensing crRNA | LwaCas13a | GATTTAGACTACCCCAAAA ACGAAGGGGACTAAAACGT TGGCTTTCGGAGATGTCTT GATAGCG | GTTGGCTT GATTTAGACTAC TCGGAGAT CCCAAAAACGAA GTCTTGAT GGGGACTAAAAC AGCG | | EGFR Exon 19 deletion |
| Exon 19 deletion wild- type sensing crRNA | LwaCas13a | GATTTAGACTACCCCAAAA ACGAAGGGGACTAAAACGA TGTTGCTTCTCTTAATTCC TTGATAG | GATGTTGC GATTTAGACTAC TTCTCTTA CCCAAAAACGAA ATTCCTTG GGGGACTAAAAC ATAG | | EGFR Exon 19 WT |
| A-allele (disease) sensing crRNA APC gene (NM_000038.5) crRNA | LwaCas13a | GATTTAGACTACCCCAAAA ACGAAGGGGACTAAAACCC TATCAGGTTTCACAGTAAG CGCGTAT | CCTATCAG GATTTAGACTAC GTTTCACA CCCAAAAACGAA GTAAGCGC GGGGACTAAAAC GTAT | | APC synthetic mutation |
| G-allele (healthy) sensing crRNA APC gene (NM_000038.5) crRNA | PsmCas13b | CCTGGTTCATGAGCTTCCT GCCACTGCCAAGTTGTAGA AGCTTATCGTTTGGATAGG TATGACAAC | CCTGGTTC GTTGTAGAAGCT ATGAGCTT TATCGTTTGGAT CCTGCCAC AGGTATGACAAC TGCCAA | | APC synthetic WT |
| DENV crRNA LbaCas13a | LbaCas13a | GTTGATGAGAAGAGCCCAA GATAGAGGGCAATAACTGC TTCTGTCCAGTGAGCATGG TCTTCG | TGCTTCTG GTTGATGAGAAG TCCAGTGA AGCCCAAGATAG GCATGGTC AGGGCAATAAC TTCG | | DENV ssRNA |
| ZIKV crRNA PsmCas13b | PsmCas13b | TGACTCCCTAGAACCACGA CAGTTTGCCTTGTTGTAGA AGCTTATCGTTTGGATAGG TATGACAAC | TGACTCCC GTTGTAGAAGCT TAGAACCA TATCGTTTGGAT CGACAGTT AGGTATGACAAC TGCCTT | | ZIKV ssRNA |

TABLE 23-continued crRNA used in this study (SEQ ID NO: 453-827).

| Name | Ortholog | Complete crRNA sequence | Spacer | Direct repeat | Target |
|---|---|---|---|---|---|
| ZIKV crRNA LbaCas13a | LbaCas13a | GTTGATGAGAAGAGCCCAA GATAGAGGGCAATAACACT CCCTAGAACCACGACAGTT TGCCTT | ACTCCCTA GAACCACG AGCCCAAGATAG ACAGTTTG AGGGCAATAAC CCTT | GTTGATGAGAAG | ZIKV ssRNA |
| DENV LbuCas13a 28nt spacer | LbuCas13a | GACCACCCCAAAAATGAAG GGGACTAAAACATGCTTCT GTCCAGTGAGCATGGTCTT CG | TGCTTCTG TCCAGTGA GCATGGTC TTCG | GACCACCCCAAA AATGAAGGGGAC TAAAACA | DENV ssRNA |
| ZIKV LbuCas13a | LbuCas13a | GACCACCCCAAAAATGAAG GGGACTAAAACAACTCCCT AGAACCACGACAGTTTGCC TT | ACTCCCTA GAACCACG ACAGTTTG CCTT | GACCACCCCAAA AATGAAGGGGAC TAAAACA | ZIKV ssRNA |
| DENV LbuCas13a 26nt spacer | LbuCas13a | GACCACCCCAAAAATGAAG GGGACTAAAACATGCTTCT GTCCAGTGAGCATGGTCTT | TGCTTCTG TCCAGTGA GCATGGTC TT | GACCACCCCAAA AATGAAGGGGAC TAAAACA | DENV ssRNA |
| DENV LbuCas13a 24nt spacer | LbuCas13a | GACCACCCCAAAAATGAAG GGGACTAAAACATGCTTCT GTCCAGTGAGCATGGTC | TGCTTCTG TCCAGTGA GCATGGTC | GACCACCCCAAA AATGAAGGGGAC TAAAACA | DENV ssRNA |
| DENV LbuCas13a 22nt spacer | LbuCas13a | GACCACCCCAAAAATGAAG GGGACTAAAACATGCTTCT GTCCAGTGAGCATGG | TGCTTCTG TCCAGTGA GCATGG | GACCACCCCAAA AATGAAGGGGAC TAAAACA | DENV ssRNA |
| DENV LbuCas13a 20nt spacer | LbuCas13a | GACCACCCCAAAAATGAAG GGGACTAAAACATGCTTCT GTCCAGTGAGCAT | TGCTTCTG TCCAGTGA GCAT | GACCACCCCAAA AATGAAGGGGAC TAAAACA | DENV ssRNA |
| DENV LbuCas13a 18nt spacer | LbuCas13a | GACCACCCCAAAAATGAAG GGGACTAAAACATGCTTCT GTCCAGTGAGC | TGCTTCTG TCCAGTGA GC | GACCACCCCAAA AATGAAGGGGAC TAAAACA | DENV ssRNA |
| CcaCas13b spacer test 34 nt | CcaCas13b | TGTTCTACCAAGTAATCCA TATTTCTAGAGGATCGTTG GAACTGCTCTCATTTTGGA GGGTAATCACAAC | TGTTCTAC CAAGTAAT GAACTGCT CTCATTTTGGAG CCATATTT GGTAATCACAAC CTAGAGGA TC | | ssRNA 1 |
| CcaCas13b spacer test 33 nt | CcaCas13b | GTTCTACCAAGTAATCCAT ATTTCTAGAGGATCGTTGG AACTGCTCTCATTTTGGAG GGTAATCACAAC | GTTCTACC AAGTAATC CATATTTC GGTAATCACAAC TAGAGGAT C | GTTGGAACTGCT CTCATTTTGGAG | ssRNA 1 |
| CcaCas13b spacer test 32 nt | CcaCas13b | TTCTACCAAGTAATCCATA TTTCTAGAGGATCGTTGGA ACTGCTCTCATTTTGGAGG GTAATCACAAC | TTCTACCA AGTAATCC ATATTTCT GTAATCACAAC AGAGGATC | GTTGGAACTGCT CTCATTTTGGAG | ssRNA 1 |
| CcaCas13b spacer test 31 nt | CcaCas13b | TCTACCAAGTAATCCATAT TTCTAGAGGATCGTTGGAA CTGCTCTCATTTTGGAGGG TAATCACAAC | TCTACCAA GTAATCCA TATTTCTA GAGGATC | GTTGGAACTGCT CTCATTTTGGAG GGTAATCACAAC | ssRNA 1 |
| CcaCas13b spacer test 30 nt | CcaCas13b | CTACCAAGTAATCCATATT TCTAGAGGATCGTTGGAAC TGCTCTCATTTTGGAGGGT AATCACAAC | CTACCAAG TAATCCAT ATTTCTAG AGGATC | GTTGGAACTGCT CTCATTTTGGAG GGTAATCACAAC | ssRNA 1 |
| CcaCas13b spacer test 29 nt | CcaCas13b | TACCAAGTAATCCATATTT CTAGAGGATCGTTGGAACT GCTCTCATTTTGGAGGGTA ATCACAAC | TACCAAGT AATCCATA TTTCTAGA GGATC | GTTGGAACTGCT CTCATTTTGGAG GGTAATCACAAC | ssRNA 1 |
| CcaCas13b spacer test 28 nt | CcaCas13b | ACCAAGTAATCCATATTTC TAGAGGATCGTTGGAACTG CTCTCATTTTGGAGGGTAA TCACAAC | ACCAAGTA ATCCATAT TTCTAGAG GATC | GTTGGAACTGCT CTCATTTTGGAG GGTAATCACAAC | ssRNA 1 |

TABLE 23-continued crRNA used in this study (SEQ ID NO: 453-827).

| Name | Ortholog | Complete crRNA sequence | Spacer | Direct repeat | Target |
|---|---|---|---|---|---|
| CcaCas13b spacer test 27 nt | CcaCas13b | CCAAGTAATCCATATTTCT AGAGGATCGTTGGAACTGC TCTCATTTTGGAGGGTAAT CACAAC | CCAAGTAA TCCATATT TCTAGAGG ATC | GTTGGAACTGCT CTCATTTTGGAG GGTAATCACAAC | ssRNA 1 |
| CcaCas13b spacer test 26 nt | CcaCas13b | CAAGTAATCCATATTTCTA GAGGATCGTTGGAACTGCT CTCATTTTGGAGGGTAATC ACAAC | CAAGTAAT CCATATTT CTAGAGGA TC | GTTGGAACTGCT CTCATTTTGGAG GGTAATCACAAC | ssRNA 1 |
| CcaCas13b spacer test 25 nt | CcaCas13b | AAGTAATCCATATTTCTAG AGGATCGTTGGAACTGCTC TCATTTTGGAGGGTAATCA CAAC | AAGTAATC CATATTTC TAGAGGAT C | GTTGGAACTGCT CTCATTTTGGAG GGTAATCACAAC | ssRNA 1 |
| CcaCas13b spacer test 24 nt | CcaCas13b | AGTAATCCATATTTCTAGA GGATCGTTGGAACTGCTCT CATTTTGGAGGGTAATCAC AAC | AGTAATCC ATATTTCT AGAGGATC | GTTGGAACTGCT CTCATTTTGGAG GGTAATCACAAC | ssRNA 1 |
| CcaCas13b spacer test 23 nt | CcaCas13b | GTAATCCATATTTCTAGAG GATCGTTGGAACTGCTCTC ATTTTGGAGGGTAATCACA AC | GTAATCCA TATTTCTA GAGGATC | GTTGGAACTGCT CTCATTTTGGAG GGTAATCACAAC | ssRNA 1 |
| CcaCas13b spacer test 22 nt | CcaCas13b | TAATCCATATTTCTAGAGG ATCGTTGGAACTGCTCTCA TTTTGGAGGGTAATCACAA C | TAATCCAT ATTTCTAG AGGATC | GTTGGAACTGCT CTCATTTTGGAG GGTAATCACAAC | ssRNA 1 |
| CcaCas13b spacer test 21 nt | CcaCas13b | AATCCATATTTCTAGAGGA TCGTTGGAACTGCTCTCAT TTTGGAGGGTAATCACAAC | AATCCATA TTTCTAGA GGATC | GTTGGAACTGCT CTCATTTTGGAG GGTAATCACAAC | ssRNA 1 |
| CcaCas13b spacer test 20 nt | CcaCas13b | ATCCATATTTCTAGAGGAT CGTTGGAACTGCTCTCATT TTGGAGGGTAATCACAAC | ATCCATAT TTCTAGAG GATC | GTTGGAACTGCT CTCATTTTGGAG GGTAATCACAAC | ssRNA 1 |
| CcaCas13b spacer test 19 nt | CcaCas13b | TCCATATTTCTAGAGGATC GTTGGAACTGCTCTCATTT TGGAGGGTAATCACAAC | TCCATATT TCTAGAGG ATC | GTTGGAACTGCT CTCATTTTGGAG GGTAATCACAAC | ssRNA 1 |
| CcaCas13b spacer test 18 nt | CcaCas13b | CCATATTTCTAGAGGATCG TTGGAACTGCTCTCATTTT GGAGGGTAATCACAAC | CCATATTT CTAGAGGA TC | GTTGGAACTGCT CTCATTTTGGAG GGTAATCACAAC | ssRNA 1 |
| CcaCas13b spacer test 17 nt | CcaCas13b | CATATTTCTAGAGGATCGT TGGAACTGCTCTCATTTTG GAGGGTAATCACAAC | CATATTTC TAGAGGAT C | GTTGGAACTGCT CTCATTTTGGAG GGTAATCACAAC | ssRNA 1 |
| CcaCas13b spacer test 16 nt | CcaCas13b | ATATTTCTAGAGGATCGTT GGAACTGCTCTCATTTTGG AGGGTAATCACAAC | ATATTTCT AGAGGATC | GTTGGAACTGCT CTCATTTTGGAG GGTAATCACAAC | ssRNA 1 |
| CcaCas13b spacer test 15 nt | CcaCas13b | TATTTCTAGAGGATCGTTG GAACTGCTCTCATTTTGGA GGGTAATCACAAC | TATTTCTA GAGGATC | GTTGGAACTGCT CTCATTTTGGAG GGTAATCACAAC | ssRNA 1 |
| CcaCas13b spacer test 14 nt | CcaCas13b | ATTTCTAGAGGATCGTTGG AACTGCTCTCATTTTGGAG GGTAATCACAAC | ATTTCTAG AGGATC | GTTGGAACTGCT CTCATTTTGGAG GGTAATCACAAC | ssRNA 1 |
| CcaCas13b spacer test 13 nt | CcaCas13b | TTTCTAGAGGATCGTTGGA ACTGCTCTCATTTTGGAGG GTAATCACAAC | TTTCTAGA GGATC | GTTGGAACTGCT CTCATTTTGGAG GGTAATCACAAC | ssRNA 1 |
| CcaCas13b spacer test 12 nt | CcaCas13b | TTCTAGAGGATCGTTGGAA CTGCTCTCATTTTGGAGGG TAATCACAAC | TTCTAGAG GATC | GTTGGAACTGCT CTCATTTTGGAG GGTAATCACAAC | ssRNA 1 |

TABLE 23-continued crRNA used in this study (SEQ ID NO: 453-827).

| Name | Ortholog | Complete crRNA sequence | Spacer | Direct repeat | Target |
|---|---|---|---|---|---|
| PsmCas13b spacer test 34 nt | PsmCas13b | TGTTCTACCAAGTAATCCA TATTTCTAGAGGATCGTTG TAGAAGCTTATCGTTTGGA TAGGTATGACAAC | TGTTCTAC CAAGTAAT CCATATTT CTAGAGGA TC | GTTGTAGAAGCT TATCGTTTGGAT AGGTATGACAAC | ssRNA 1 |
| PsmCas13b spacer test 33 nt | PsmCas13b | GTTCTACCAAGTAATCCAT ATTTCTAGAGGATCGTTGT AGAAGCTTATCGTTTGGAT AGGTATGACAAC | GTTCTACC AAGTAATC CATATTTC TAGAGGAT C | GTTGTAGAAGCT TATCGTTTGGAT AGGTATGACAAC | ssRNA 1 |
| PsmCas13b spacer test 32 nt | PsmCas13b | TTCTACCAAGTAATCCATA TTTCTAGAGGATCGTTGTA GAAGCTTATCGTTTGGATA GGTATGACAAC | TTCTACCA AGTAATCC ATATTTCT AGAGGATC | GTTGTAGAAGCT TATCGTTTGGAT AGGTATGACAAC | ssRNA 1 |
| PsmCas13b spacer test 31 nt | PsmCas13b | TCTACCAAGTAATCCATAT TTCTAGAGGATCGTTGTAG AAGCTTATCGTTTGGATAG GTATGACAAC | TCTACCAA GTAATCCA TATTTCTA GAGGATC | GTTGTAGAAGCT TATCGTTTGGAT AGGTATGACAAC | ssRNA 1 |
| PsmCas13b spacer test 30 nt | PsmCas13b | CTACCAAGTAATCCATATT TCTAGAGGATCGTTGTAGA AGCTTATCGTTTGGATAGG TATGACAAC | CTACCAAG TAATCCAT ATTTCTAG AGGATC | GTTGTAGAAGCT TATCGTTTGGAT AGGTATGACAAC | ssRNA 1 |
| PsmCas13b spacer test 29 nt | PsmCas13b | TACCAAGTAATCCATATTT CTAGAGGATCGTTGTAGAA GCTTATCGTTTGGATAGGT ATGACAAC | TACCAAGT AATCCATA TTTCTAGA GGATC | GTTGTAGAAGCT TATCGTTTGGAT AGGTATGACAAC | ssRNA 1 |
| PsmCas13b spacer test 28 nt | PsmCas13b | ACCAAGTAATCCATATTTC TAGAGGATCGTTGTAGAAG CTTATCGTTTGGATAGGTA TGACAAC | ACCAAGTA ATCCATAT TTCTAGAG GATC | GTTGTAGAAGCT TATCGTTTGGAT AGGTATGACAAC | ssRNA 1 |
| PsmCas13b spacer test 27 nt | PsmCas13b | CCAAGTAATCCATATTTCT AGAGGATCGTTGTAGAAGC TTATCGTTTGGATAGGTAT GACAAC | CCAAGTAA TCCATATT TCTAGAGG ATC | GTTGTAGAAGCT TATCGTTTGGAT AGGTATGACAAC | ssRNA 1 |
| PsmCas13b spacer test 26 nt | PsmCas13b | CAAGTAATCCATATTTCTA GAGGATCGTTGTAGAAGCT TATCGTTTGGATAGGTATG ACAAC | CAAGTAAT CCATATTT CTAGAGGA TC | GTTGTAGAAGCT TATCGTTTGGAT AGGTATGACAAC | ssRNA 1 |
| PsmCas13b spacer test 25 nt | PsmCas13b | AAGTAATCCATATTTCTAG AGGATCGTTGTAGAAGCTT ATCGTTTGGATAGGTATGA CAAC | AAGTAATC CATATTTC TAGAGGAT C | GTTGTAGAAGCT TATCGTTTGGAT AGGTATGACAAC | ssRNA 1 |
| PsmCas13b spacer test 24 nt | PsmCas13b | AGTAATCCATATTTCTAGA GGATCGTTGTAGAAGCTTA TCGTTTGGATAGGTATGAC AAC | AGTAATCC ATATTTCT AGAGGATC | GTTGTAGAAGCT TATCGTTTGGAT AGGTATGACAAC | ssRNA 1 |
| PsmCas13b spacer test 23 nt | PsmCas13b | GTAATCCATATTTCTAGAG GATCGTTGTAGAAGCTTAT CGTTTGGATAGGTATGACA AC | GTAATCCA TATTTCTA GAGGATC | GTTGTAGAAGCT TATCGTTTGGAT AGGTATGACAAC | ssRNA 1 |
| PsmCas13b spacer test 22 nt | PsmCas13b | TAATCCATATTTCTAGAGG ATCGTTGTAGAAGCTTATC GTTTGGATAGGTATGACAA C | TAATCCAT ATTTCTAG AGGATC | GTTGTAGAAGCT TATCGTTTGGAT AGGTATGACAAC | ssRNA 1 |
| PsmCas13b spacer test 21 nt | PsmCas13b | AATCCATATTTCTAGAGGA TCGTTGTAGAAGCTTATCG TTTGGATAGGTATGACAAC | AATCCATA TTTCTAGA GGATC | GTTGTAGAAGCT TATCGTTTGGAT AGGTATGACAAC | ssRNA 1 |
| PsmCas13b spacer test 20 nt | PsmCas13b | ATCCATATTTCTAGAGGAT CGTTGTAGAAGCTTATCGT TTGGATAGGTATGACAAC | ATCCATAT TTCTAGAG GATC | GTTGTAGAAGCT TATCGTTTGGAT AGGTATGACAAC | ssRNA 1 |

TABLE 23-continued crRNA used in this study (SEQ ID NO: 453-827).

| Name | Ortholog | Complete crRNA sequence | Spacer | Direct repeat | Target |
|---|---|---|---|---|---|
| PsmCas13b spacer test 19 nt | PsmCas13b | TCCATATTTCTAGAGGATC GTTGTAGAAGCTTATCGTTT TGGATAGGTATGACAAC | TCCATATT TCTAGAGG ATC | GTTGTAGAAGCT TATCGTTTGGAT AGGTATGACAAC | ssRNA 1 |
| PsmCas13b spacer test 18 nt | PsmCas13b | CCATATTTCTAGAGGATCG TTGTAGAAGCTTATCGTTT GGATAGGTATGACAAC | CCATATTT CTAGAGGA TC | GTTGTAGAAGCT TATCGTTTGGAT AGGTATGACAAC | ssRNA 1 |
| PsmCas13b spacer test 17 nt | PsmCas13b | CATATTTCTAGAGGATCGT TGTAGAAGCTTATCGTTTG GATAGGTATGACAAC | CATATTTC TAGAGGAT C | GTTGTAGAAGCT TATCGTTTGGAT AGGTATGACAAC | ssRNA 1 |
| PsmCas13b spacer test 16 nt | PsmCas13b | ATATTTCTAGAGGATCGTT GTAGAAGCTTATCGTTTGG ATAGGTATGACAAC | ATATTTCT AGAGGATC | GTTGTAGAAGCT TATCGTTTGGAT AGGTATGACAAC | ssRNA 1 |
| PsmCas13b spacer test 15 nt | PsmCas13b | TATTTCTAGAGGATCGTTG TAGAAGCTTATCGTTTGGA TAGGTATGACAAC | TATTTCTA GAGGATC | GTTGTAGAAGCT TATCGTTTGGAT AGGTATGACAAC | ssRNA 1 |
| PsmCas13b spacer test 14 nt | PsmCas13b | ATTTCTAGAGGATCGTTGT AGAAGCTTATCGTTTGGAT AGGTATGACAAC | ATTTCTAG AGGATC | GTTGTAGAAGCT TATCGTTTGGAT AGGTATGACAAC | ssRNA 1 |
| PsmCas13b spacer test 13 nt | PsmCas13b | TTTCTAGAGGATCGTTGTA GAAGCTTATCGTTTGGATA GGTATGACAAC | TTTCTAGA GGATC | GTTGTAGAAGCT TATCGTTTGGAT AGGTATGACAAC | ssRNA 1 |
| PsmCas13b spacer test 12 nt | PsmCas13b | TTCTAGAGGATCGTTGTAG AAGCTTATCGTTTGGATAG GTATGACAAC | TTCTAGAG GATC | GTTGTAGAAGCT TATCGTTTGGAT AGGTATGACAAC | ssRNA 1 |
| LwaCas13a tiling crRNA 1 | LwaCas13a | GATTTAGACTACCCCAAAA ACGAAGGGGACTAAAACCC GGGTACCGAGCTCGAATTC ACTGGCC | CCGGGTAC CGAGCTCG AATTCACT GGCC | GATTTAGACTAC CCCAAAAACGAA GGGGACTAAAAC | ssRNA 1 |
| LwaCas13a tiling crRNA 2 | LwaCas13a | GATTTAGACTACCCCAAAA ACGAAGGGGACTAAAACTT TCTAGAGGATCCCCGGGTA CCGAGCT | TTTCTAGA GGATCCCC GGGTACCG AGCT | GATTTAGACTAC CCCAAAAACGAA GGGGACTAAAAC | ssRNA 1 |
| LwaCas13a tiling crRNA 3 | LwaCas13a | GATTTAGACTACCCCAAAA ACGAAGGGGACTAAAACCC AAGTAATCCATATTTCTAG AGGATCC | CCAAGTAA TCCATATT TCTAGAGG ATCC | GATTTAGACTAC CCCAAAAACGAA GGGGACTAAAAC | ssRNA 1 |
| LwaCas13a tiling crRNA 4 | LwaCas13a | GATTTAGACTACCCCAAAA ACGAAGGGGACTAAAACAG ATTGCTGTTCTACCAAGTA ATCCATA | AGATTGCT GTTCTACC AAGTAATC CATA | GATTTAGACTAC CCCAAAAACGAA GGGGACTAAAAC | ssRNA 1 |
| LwaCas13a tiling crRNA 5 | LwaCas13a | GATTTAGACTACCCCAAAA ACGAAGGGGACTAAAACCC TGCAGGTCGAGTAGATTGC TGTTCTA | CCTGCAGG TCGAGTAG ATTGCTGT TCTA | GATTTAGACTAC CCCAAAAACGAA GGGGACTAAAAC | ssRNA 1 |
| LwaCas13a tiling crRNA 6 | LwaCas13a | GATTTAGACTACCCCAAAA ACGAAGGGGACTAAAACGC CAAGCTTGCATGCCTGCAG GTCGAGT | GCCAAGCT TGCATGCC TGCAGGTC GAGT | GATTTAGACTAC CCCAAAAACGAA GGGGACTAAAAC | ssRNA 1 |
| LwaCas13a tiling crRNA 7 | LwaCas13a | GATTTAGACTACCCCAAAA ACGAAGGGGACTAAAACAT GACCATGATTACGCCAAGC TTGCATG | ATGACCAT GATTACGC CAAGCTTG CATG | GATTTAGACTAC CCCAAAAACGAA GGGGACTAAAAC | ssRNA 1 |
| LwaCas13a tiling crRNA 8 | LwaCas13a | GATTTAGACTACCCCAAAA ACGAAGGGGACTAAAACCA CAGGAAACAGCTATGACCA TGATTAC | CACAGGAA ACAGCTAT GACCATGA TTAC | GATTTAGACTAC CCCAAAAACGAA GGGGACTAAAAC | ssRNA 1 |

TABLE 23-continued crRNA used in this study (SEQ ID NO: 453-827).

| Name | Ortholog | Complete crRNA sequence | Spacer | Direct repeat | Target |
|---|---|---|---|---|---|
| LwaCas13a tiling crRNA 9 | LwaCas13a | GATTTAGACTACCCCAAAA ACGAAGGGGACTAAAACTG TGAGCGGATAAACACAGGA AACAGCT | TGTGAGCG GATAAACA CAGGAAAC AGCT | GATTTAGACTAC CCCAAAAACGAA GGGGACTAAAAC | ssRNA 1 |
| LwaCas13a tiling crRNA 10 | LwaCas13a | GATTTAGACTACCCCAAAA ACGAAGGGGACTAAAACAT GTTGTGTGGAATTGTGAGC GGATAAA | ATGTTGTG TGGAATTG TGAGCGGA | GATTTAGACTAC CCCAAAAACGAA GGGGACTAAAAC TAAA | ssRNA 1 |
| LwaCas13a tiling crRNA 11 | LwaCas13a | GATTTAGACTACCCCAAAA ACGAAGGGGACTAAAACTG CTTCCGGCTCGTATGTTGT GTGGAAT | TGCTTCCG GCTCGTAT GTTGTGTG GAAT | GATTTAGACTAC CCCAAAAACGAA GGGGACTAAAAC | ssRNA 1 |
| CcaCas13b tiling crRNA 1 | CcaCas13b | CCCCGGGTACCGAGCTCGA ATTCACTGGCCGTTGGAAC TGCTCTCATTTTGGAGGGT AATCACAAC | CCCCGGGT ACCGAGCT CGAATTCA CTGGCC | GTTGGAACTGCT CTCATTTTGGAG GGTAATCACAAC | ssRNA 1 |
| CcaCas13b tiling crRNA 2 | CcaCas13b | TATTTCTAGAGGATCCCCG GGTACCGAGCTGTTGGAAC TGCTCTCATTTTGGAGGGT AATCACAAC | TATTTCTA GAGGATCC CCGGGTAC CGAGCT | GTTGGAACTGCT CTCATTTTGGAG GGTAATCACAAC | ssRNA 1 |
| CcaCas13b tiling crRNA 3 | CcaCas13b | TACCAAGTAATCCATATTT CTAGAGGATCCGTTGGAAC TGCTCTCATTTTGGAGGGT AATCACAAC | TACCAAGT AATCCATA TTTCTAGA GGATCC | GTTGGAACTGCT CTCATTTTGGAG GGTAATCACAAC | ssRNA 1 |
| CcaCas13b tiling crRNA 4 | CcaCas13b | GTAGATTGCTGTTCTACCA AGTAATCCATAGTTGGAAC TGCTCTCATTTTGGAGGGT AATCACAAC | GTAGATTG CTGTTCTA CCAAGTAA TCCATA | GTTGGAACTGCT CTCATTTTGGAG GGTAATCACAAC | ssRNA 1 |
| CcaCas13b tiling crRNA 5 | CcaCas13b | TGCCTGCAGGTCGAGTAGA TTGCTGTTCTAGTTGGAAC TGCTCTCATTTTGGAGGGT AATCACAAC | TGCCTGCA GGTCGAGT AGATTGCT GTTCTA | GTTGGAACTGCT CTCATTTTGGAG GGTAATCACAAC | ssRNA 1 |
| CcaCas13b tiling crRNA 6 | CcaCas13b | ACGCCAAGCTTGCATGCCT GCAGGTCGAGTGTTGGAAC TGCTCTCATTTTGGAGGGT AATCACAAC | ACGCCAAG CTTGCATG CCTGCAGG TCGAGT | GTTGGAACTGCT CTCATTTTGGAG GGTAATCACAAC | ssRNA 1 |
| CcaCas13b tiling crRNA 7 | CcaCas13b | CTATGACCATGATTACGCC AAGCTTGCATGGTTGGAAC TGCTCTCATTTTGGAGGGT AATCACAAC | CTATGACC ATGATTAC GCCAAGCT TGCATG | GTTGGAACTGCT CTCATTTTGGAG GGTAATCACAAC | ssRNA 1 |
| CcaCas13b tiling crRNA 8 | CcaCas13b | AACACAGGAAACAGCTATG ACCATGATTACGTTGGAAC TGCTCTCATTTTGGAGGGT AATCACAAC | AACACAGG AAACAGCT ATGACCAT GATTAC | GTTGGAACTGCT CTCATTTTGGAG GGTAATCACAAC | ssRNA 1 |
| CcaCas13b tiling crRNA 9 | CcaCas13b | ATTGTGAGCGGATAAACAC AGGAAACAGCTGTTGGAAC TGCTCTCATTTTGGAGGGT AATCACAAC | ATTGTGAG CGGATAAA CACAGGAA ACAGCT | GTTGGAACTGCT CTCATTTTGGAG GGTAATCACAAC | ssRNA 1 |
| CcaCas13b tiling crRNA 10 | CcaCas13b | GTATGTTGTGTGGAATTGT GAGCGGATAAAGTTGGAAC TGCTCTCATTTTGGAGGGT AATCACAAC | GTATGTTG TGTGGAAT TGAGCGGA GATAAA | GTTGGAACTGCT CTCATTTTGGAG GGTAATCACAAC | ssRNA 1 |
| CcaCas13b tiling crRNA 11 | CcaCas13b | TATGCTTCCGGCTCGTATG TTGTGTGGAATGTTGGAAC TGCTCTCATTTTGGAGGGT AATCACAAC | TATGCTTC CGGCTCGT CTCATTTTGGAG GGTAATCACAAC TGGAAT | GTTGGAACTGCT ATGTTGTG | ssRNA 1 |
| PsmCas13b tiling crRNA 1 | PsmCas13b | CCCCGGGTACCGAGCTCGA ATTCACTGGCCGTTGTAGA AGCTTATCGTTTGGATAGG TATGACAAC | CCCCGGGT ACCGAGCT TATCGTTTGGAT CGAATTCA CTGGCC | GTTGTAGAAGCT AGGTATGACAAC | ssRNA 1 |

TABLE 23-continued crRNA used in this study (SEQ ID NO: 453-827).

| Name | Ortholog | Complete crRNA sequence | Spacer | Direct repeat | Target |
|---|---|---|---|---|---|
| PsmCas13b tiling crRNA 2 | PsmCas13b | TATTTCTAGAGGATCCCCG GGTACCGAGCTGTTGTAGA AGCTTATCGTTTGGATAGG TATGACAAC | TATTTCTA GAGGATCC CCGGGTAC CGAGCT | GTTGTAGAAGCT TATCGTTTGGAT AGGTATGACAAC | ssRNA 1 |
| PsmCas13b tiling crRNA 3 | PsmCas13b | TACCAAGTAATCCATATTT CTAGAGGATCCGTTGTAGA AGCTTATCGTTTGGATAGG TATGACAAC | TACCAAGT AATCCATA TTTCTAGA GGATCC | GTTGTAGAAGCT TATCGTTTGGAT AGGTATGACAAC | ssRNA 1 |
| PsmCas13b tiling crRNA 4 | PsmCas13b | GTAGATTGCTGTTCTACCA AGTAATCCATAGTTGTAGA AGCTTATCGTTTGGATAGG TATGACAAC | GTAGATTG CTGTTCTA CCAAGTAA TCCATA | GTTGTAGAAGCT TATCGTTTGGAT AGGTATGACAAC | ssRNA 1 |
| PsmCas13b tiling crRNA 5 | PsmCas13b | TGCCTGCAGGTCGAGTAGA TTGCTGTTCTAGTTGTAGA AGCTTATCGTTTGGATAGG TATGACAAC | TGCCTGCA GGTCGAGT AGATTGCT GTTCTA | GTTGTAGAAGCT TATCGTTTGGAT AGGTATGACAAC | ssRNA 1 |
| PsmCas13b tiling crRNA 6 | PsmCas13b | ACGCCAAGCTTGCATGCCT GCAGGTCGAGTGTTGTAGA AGCTTATCGTTTGGATAGG TATGACAAC | ACGCCAAG CTTGCATG CCTGCAGG TCGAGT | GTTGTAGAAGCT TATCGTTTGGAT AGGTATGACAAC | ssRNA 1 |
| PsmCas13b tiling crRNA 7 | PsmCas13b | CTATGACCATGATTACGCC AAGCTTGCATGGTTGTAGA AGCTTATCGTTTGGATAGG TATGACAAC | CTATGACC ATGATTAC GCCAAGCT TGCATG | GTTGTAGAAGCT TATCGTTTGGAT AGGTATGACAAC | ssRNA 1 |
| PsmCas13b tiling crRNA 8 | PsmCas13b | AACACAGGAAACAGCTATG ACCATGATTACGTTGTAGA AGCTTATCGTTTGGATAGG TATGACAAC | AACACAGG AAACAGCT ATGACCAT GATTAC | GTTGTAGAAGCT TATCGTTTGGAT AGGTATGACAAC | ssRNA 1 |
| PsmCas13b tiling crRNA 9 | PsmCas13b | ATTGTGAGCGGATAAACAC AGGAAACAGCTGTTGTAGA AGCTTATCGTTTGGATAGG TATGACAAC | ATTGTGAG CGGATAAA CACAGGAA ACAGCT | GTTGTAGAAGCT TATCGTTTGGAT AGGTATGACAAC | ssRNA 1 |
| PsmCas13b tiling crRNA 10 | PsmCas13b | GTATGTTGTGTGGAATTGT GAGCGGATAAAGTTGTAGA AGCTTATCGTTTGGATAGG TATGACAAC | GTATGTTG TGTGGAAT TGTGAGCG GATAAA | GTTGTAGAAGCT TATCGTTTGGAT AGGTATGACAAC | ssRNA 1 |
| PsmCas13b tiling crRNA 11 | PsmCas13b | TATGCTTCCGGCTCGTATG TTGTGTGGAATGTTGTAGA AGCTTATCGTTTGGATAGG TATGACAAC | TATGCTTC CGGCTCGT ATGTTGTG TGGAAT | GTTGTAGAAGCT TATCGTTTGGAT AGGTATGACAAC | ssRNA 1 |
| ZIKV CcaCas13b | CcaCas13b | CTTGAACTCTACCAGTGCT TCTTTGTTGTTGGAACTGCTCTCATTTTGGAGGGTAATCACAAC | CTTGAACT CTACCAGT CTCATTTTGGAG GCTTCTTT GTTGTT | GTTGGAACTGCT GGTAATCACAAC | ZIKV ssRNA |
| DENV crRNA CcaCas13b | CcaCas13b | TTTGCTTCTGTCCAGTGAG CATGGTCTTCGGTTGGAAC TGCTCTCATTTTGGAGGGT AATCACAAC | TTTGCTTC TGTCCAGT GAGCATGG TCTTCG | GTTGGAACTGCT CTCATTTTGGAG GGTAATCACAAC | DENV ssRNA |
| human ID rs601338 A-allele sensing PsmCas13b | PsmCas13b | CCGCTTCACCGGCTACCCC TGCTCCAAGAGTTGTAGAA GCTTATCGTTTGGATAGGT ATGACAAC | CCGCTTCA CCGGCTAC CCCTGCTC CAAGA | GTTGTAGAAGCT TATCGTTTGGAT AGGTATGACAAC | Human locus rs601338 |
| human ID rs601338 G-allele sensing LwaCas13a | LwaCas13a | GATTTAGACTACCCCAAAA ACGAAGGGGACTAAAACCT GCACCTTCTACCACCACCT CCGCCAG | CTGCACCT TCTACCAC CACCTCCG CCAG | GATTTAGACTAC CCCAAAAACGAA GGGGACTAAAAC | Human locus rs601338 |
| ssRNA/ssDNA 1 crRNA 1 | LwaCas13a | GATTTAGACTACCCCAAAA ACGAAGGGGACTAAAACTA GATTGCTGTTCTACCAAGT AATCCAT | TAGATTGC TGTTCTAC CAAGTAAT CCAT | GATTTAGACTAC CCCAAAAACGAA GGGGACTAAAAC | ssRNA 1 |

TABLE 23-continued crRNA used in this study (SEQ ID NO: 453-827).

| Name | Ortholog | Complete crRNA sequence | Spacer | Direct repeat | Target |
|---|---|---|---|---|---|
| T790M mutant sensing allele crRNA | LwaCas13a | GATTTAGACTACCCCAAAA ACGAAGGGGACTAAAACGC AAGATGAGCTGCACGGTGG AGGTGAG | GCAAGATG AGCTGCAC GGTGGAGG AGGTGAG | GATTTAGACTAC CCCAAAAACGAA GGGGACTAAAAC TGAG | EGFR T790M mutant synthetic ssDNA |
| T790M wild type sensing allele crRNA | LwaCas13a | GATTTAGACTACCCCAAAA ACGAAGGGGACTAAAACGC GTCATGAGCTGCACGGTGG AGGTGAG | GCGTCATG AGCTGCAC GGTGGAGG | GATTTAGACTAC CCCAAAAACGAA GGGGACTAAAAC TGAG | EGFR T790M WT synthetic ssDNA |
| ssRNA 3 (PsmCas13b target) crRNA | PsmCas13b | TAGATTGCTGTTCTACCAA GTAATCCATATGTTGTAGA AGCTTATCGTTTGGATAGG TATGACAAC | TAGATTGC GTTGTAGAAGCT TGTTCTAC TATCGTTTGGAT CAAGTAAT AGGTATGACAAC CCATAT | ssRNA 3 |
| ssRNA 2 (LwaCas13a target) crRNA | LwaCas13a | GATTTAGACTACCCCAAAA ACGAAGGGGACTAAAACGA TTGCTGTTCTACCAAGTAA TCCATAT | GATTGCTG GATTTAGACTAC TTCTACCA CCCAAAAACGAA AGTAATCC GGGGACTAAAAC ATAT | ssRNA 2 |

TABLE 24

RNA and DNA targets used in this study (SEQ ID NO: 828-840).

| Name | Sequence | Nucleic acid |
|---|---|---|
| DENV ssRNA | AGUACAUAUUCAGGGGCCAACCUCUCAACAAUGACGAAGACCAUGCUC ACUGGACAGAAGCAAAAAUGCUGCUGGACAACAUCAACACACCAGAAG GGAUUAUACCAGCUCUCUUUGAACCAGAAAGGGAGAAGUCAGCCGCCA UAGACGGUGAAUACCGCCUGAAGGGU | RNA |
| ssDNA 1 | GGCCAGTGAATTCGAGCTCGGTACCCGGGGATCCTCTAGAAATATGGA TTACTTGgtAGAACAGCAATCTACTCGACCTGCAGGCATGCAAGCTTG GCGTAATCATGGTCATAGCTGTTTCCTGTGTTTATCCGCTCACAATTC CACACAACATACGAGCCGGAAGCATAAAG | DNA |
| ZIKV ssRNA | GACACCGGAACUCCACACUGGAACAACAAAGAAGCACUGGUAGAGUUC AAGGACGCACAUGCCAAAAGGCAAACUGUCGUGGUUCUAGGGAGUCAA GAAGGAGCAGUUCACACGGCCCUUGCUGGAGCUCUGGAGGCUGAGAUG GAUGGUGCAAAGGGAAGGCUGUCCUCUGGC | RNA |
| Thermonuclease ssDNA | TTAATTAAAGCGATTGATGGTGATACTGTTAAATTAATGTACAAAGGT CAACCAATGACATTCAGACTATTATTGGTTGATACACCTGAAACAAAG CATCCTAAAAAAGGTGTAGAGAAATATGGTCCTGAAGCAAGTGCATTT ACGAAAAAGATGGTAGAAAATGCAAAGAAAATTGAAGTCGAGTTTG | DNA |
| Acyltransferase ssDNA | GGGGAGGATGTCGGGCGCGCACGTTTTCCCTTCGCTGAGCACGCTGCG CGCGTCGCCTACGTGAATGCGCTGTTCGATGCGTTGGCCGAAGGCAAC CCGCGGGTGAGCGTGCTCGACCCCTCCAGCGTGCTCTGCGATGGCCTG GATTGTTTCGCCGAACGTGATGGCTGGTCGCTGTACATGGATAACA | DNA |
| ssRNA 1 | GGCCAGUGAAUUCGAGCUCGGUACCCGGGGAUCCUCUAGAAAUAUGGA UUACUUGgUAGAACAGCAAUCUACUCGACCUGCAGGCAUGCAAGCUUG GCGUAAUCAUGGUCAUAGCUGUUUCCUGUGUUUAUCCGCUCACAAUUC CACACAACAUACGAGCCGGAAGCAUAAAG | RNA |
| Random motif library | TTCCTGTGAAGCTAAAGAAGGAGAATGrNrNrNrNrNrNTATTGATAG CAGCTGTGGCACCTGCAC | Mixed DNA/RNA |
| EGFR Exon19 deletion mutant synthetic ssDNA | TGCCAGTTAACGTCTTCCTTCTCTCTCTGTCATAGGGACTCTGGATCC CAGAAGGTGAGAAAGTTAAAATTCCCGTCGCTATCAAGACATCTCCGA AAGCCAACAAGGAAATCCTCGATGTGAGTTTCTGCTTTGCTGTGTGGG GGTCCATGGCTCTGAACCTCAGGCCCACCTTTTCTCAT | DNA |
| EGFR Exon19 deletion WT synthetic ssDNA | TGCCAGTTAACGTCTTCCTTCTCTCTCTGTCATAGGGACTCTGGATCC CAGAAGGTGAGAAAGTTAAAATTCCCGTCGCTATCAAGGAATTAAGAG AAGCAACATCTCCGAAAGCCAACAAGGAAATCCTCGATGTGAGTTTCT GCTTTGCTGTGTGGGGGTCCATGGCTCTGAACCTCAGGCCCACCTTTT CTCAT | DNA |

TABLE 24-continued

RNA and DNA targets used in this study (SEQ ID NO: 828-840).

| Name | Sequence | Nucleic acid |
|---|---|---|
| EGFR T790M mutant synthetic ssDNA | CCTCCCTCCAGGAAGCCTACGTGATGGCCAGCGTGGACAACCCCCACG TGTGCCGCCTGCTGGGCATCTGCCTCACCTCCACCGTGCAGCTCATCA TGCAGCTCATGCCCTTCGGCTGCCTCCTGGACTATGTCCGGGAACACA AAGACAATATTGGCTCCCAGTACCTGCTCAACTGGTGTGTGCAGATCG CA | DNA |
| EGFR T790M WT synthetic ssDNA | CCTCCCTCCAGGAAGCCTACGTGATGGCCAGCGTGGACAACCCCCACG TGTGCCGCCTGCTGGGCATCTGCCTCACCTCCACCGTGCAGCTCATCA CGCAGCTCATGCCCTTCGGCTGCCTCCTGGACTATGTCCGGGAACACA AAGACAATATTGGCTCCCAGTACCTGCTCAACTGGTGTGTGCAGATCG CA | DNA |
| ssRNA 2 (LwaCas13a target | UAGGUGUUCCACAGGGUAGCCAGCAGCAUCCUGCGAUGCAAAUAUGGA UUACUUGGUAGAACAGCAAUCUAAUCCGGAACAUAAUGGUGCAGGGCG CUGACUUCCGCGUUUGUUUUAAAUCAAACACGGAAACCGAAGACCAUU CAUGUUGUUGCUGCCGGAAGCAUAAAG | RNA |
| ssRNA 3 (PsmCas13b target | UAGGUGUUCCACAGGGUAGCCAGCAGCAUCCUGCGAUGCAAAUAUGGA UUACUUGGUAGAACAGCAAUCUAAUCCGGAACAUAAUGGUGCAGGGCG CUGACUUCCGCGUUUGAAAAAAAACAAACACGGAAACCGAAGACCAUU CAUGUUGUUGCUGCCGGAAGCAUAAAG | RNA |

TABLE 25

RPA primers used in this study (SEQ ID NO:841-870).

| Target | Forward primer sequence | Forward primer sequence (with T7 RNAP promoter) | Reverse primer sequence |
|---|---|---|---|
| DENV ssRNA | GTACATATTCAGGGGCCAACCTC TC | gaaattaatacgactcactatagggTTTCTGGTTCAAAG GTACATATTCAGGGGCCAACCTCTCAGAGCTGGTAT | |
| Thermonuc lease ssDNA | TGTACAAAGGTCAACCAATGACA TTCAG | gaaatTAATACGACTCACTATAGGGTGCACTTGCTTCAG TGTACAAAGGTCAACCAATGACATTGACCATATTTC CAG | |
| Acyltransfe rase | CTACGTGAATGCGCTGTTCGATG | gaaatTAATACGACTCACTATAGGGGAAACAATCCAGGC CTACGTGAATGCGCTGTTCGATG CATCGCAGAG | |
| EGFR L858R | TCTGGATCCCAGAAGGTGAGAAA GTTAAAA | gaaatTAATACGACTCACTATAGGGCCACACAGCAAAGC TCTGGATCCCAGAAGGTGAGAAAGTAGAAACTCACATCG TAAAA AG | |
| EGFR Exon19 deletion | TCTGGATCCCAGAAGGTGAGAAA GTTAAAA | gaaatTAATACGACTCACTATAGGGCCACACAGCAAAGC TCTGGATCCCAGAAGGTGAGAAAGTAGAAACTCACATCG TAAAA AG | |
| Theranostic APC target (NM_0000 38.5) | AGGGCCGCCACTCCACCGGCGGC ATGGATGAG | gaaatTAATACGACTCACTATAGGGGAAGAGTTCTTCAC AGGGCCGCCACTCCACCGGCGGCATCTTTACTCACggaT GGATGAG CCtcc | |
| ZIKV ssRNA | CCACACTGGAACAACAAAGAAGC AC | gaaatTAATACGACTCACTATAGGGACAGCCTTCCCTTT CCACACTGGAACAACAAAGAAGCACGCACCATCCATCTC AG | |
| locus rs601338 | ATAGTCCCCTCGGCGAACATGGA CCCCTACAA | gaaattaatacgactcactatagggGAGTACGTCCGCTT ATAGTCCCCTCGGCGAACATGGACCCCACCGGCTACCCT CCTACAA GCTC | |
| SSDNA/ssR NA 1 | ATCCTCTAGAAATATGGATTACT TGGTAGAACAG | AATTCTAATACGACTCACTATAGGGGATAAACACAGGAA ATCCTCTAGAAATATGGATTACTTGACAGCTATGACCAT GTAGAACAG GATTACG | |
| EGFR T790M | CCCCACGTGTGCCGCCTGCTGGG CATCTGC | gaaatTAATACGACTCACTATAGGGATATTGTCTTTGTG CCCCACGTGTGCCGCCTGCTGGGCATTCCCGGACATAGT TCTGC CC | |

TABLE 26

Cleavage reporters used in this study (SEQ ID NO:871-877).

| Name | Sequence | Fluorophore |
|---|---|---|
| poly U reporter | /56-FAM/rUrUrUrUrU/3IABkFQ/ | FAM |
| poly A reporter | /56-FAM/rArArArArA/3IABkFQ/ | FAM |
| poly U reporter for multiplexing | /5HEX/rUrUrUrUrU/3IABkFQ/ | HEX |
| rArA reporter for testing di-base preference | /56-FAM/TArArAGC/3IABkFQ/ | FAM |
| rArU reporter for testing di-base preference | /56-FAM/TArArUGC/3IABkFQ/ | FAM |
| rArC reporter for testing di-base preference | /56-FAM/TArArCGC/3IABkFQ/ | FAM |
| rArG reporter for testing di-base preference | /56-FAM/TArArGGC/3IABkFQ/ | FAM |
| rUrA reporter for testing di-base preference | /56-FAM/TArUrAGC/3IABkFQ/ | FAM |
| rUrU reporter for testing di-base preference | /56-FAM/TArUrUGC/3IABkFQ/ | FAM |
| rUrC reporter for testing di-base preference | /56-FAM/TArUrCGC/3IABkFQ/ | FAM |
| rUrG reporter for testing di-base preference | /56-FAM/TArUrGGC/3IABkFQ/ | FAM |
| rCrA reporter for testing di-base preference | /56-FAM/TArCrAGC/3IABkFQ/ | FAM |
| rCrU reporter for testing di-base preference | /56-FAM/TArCrUGC/3IABkFQ/ | FAM |
| rCrC reporter for testing di-base preference | /56-FAM/TArCrCGC/3IABkFQ/ | FAM |
| rCrG reporter for testing di-base preference | /56-FAM/TArCrGGC/3IABkFQ/ | FAM |
| rGrA reporter for testing di-base preference | /56-FAM/TArGrAGC/3IABkFQ/ | FAM |
| rGrU reporter for testing di-base preference | /56-FAM/TArGrUGC/3IABkFQ/ | FAM |
| rGrC reporter for testing di-base preference | /56-FAM/TArGrCGC/3IABkFQ/ | FAM |
| rGrG reporter for testing di-base preference | /56-FAM/TArGrGGC/3IABkFQ/ | FAM |
| poly U Cy5 for multiplexing | /5Cy5/rUrUrUrUrU/3IAbRQSp/ | FAM |
| Lateral flow flow reporter with FAM/Biotin | /56-FAM/mArArUrGrGrCmAmArArUrGrGrCmA/3Bio/ | N/A |
| poly C reporter | /56-FAM/rCrCrCrCrC/3IABkFQ/ | FAM |
| poly G reporter | /56-FAM/rGrGrGrGrG/3IABkFQ/ | FAM |
| RNA motif library for base preference screening | TTCCTGTGAAGCTAAAGAAGGAGAATGrNrNrNrNrNrNTATTGATAGCAGCTGTGGCACCTGCAC | N/A |
| LwaCas13a validation motif 1 | /56-FAM/TrGrUrUrUrUrC/3IABkFQ/ | FAM |
| LwaCas13a validation motif 2 | /56-FAM/TrUrUrUrUrUrC/3IABkFQ/ | FAM |
| LwaCas13a validation motif 3 | /56-FAM/TrCrArUrUrUrG/3IABkFQ/ | FAM |

TABLE 26-continued

Cleavage reporters used in this study (SEQ ID NO:871-877).

| Name | Sequence | Fluorophore |
|---|---|---|
| PsmCas13b validation motif 1 | /56-FAM/TrUrArUrUrGrA/3IABkFQ/ | FAM |
| PsmCas13b validation motif 2 | /56-FAM/TrArUrUrGrArU/3IABkFQ/ | FAM |
| PsmCas13b validation motif 3 | /56-FAM/TrUrUrGrArUrA/3IABkFQ/ | FAM |
| CcaCas13b validation motif 1 | /56-FAM/TrUrUrUrGrUrU/3IABkFQ/ | FAM |
| CcaCas13b validation motif 2 | /56-FAM/TrUrGrUrUrUrU/3IABkFQ/ | FAM |
| CcaCas13b validation motif 3 | /56-FAM/TrArUrUrUrU/3IABkFQ/ | FAM |
| Lwa orthogonal motif 1 | /56-FAM/TrCrGrArArUrG/3IABkFQ/ | FAM |
| Lwa orthogonal motif 2 | /56-FAM/TrGrUrCrUrCrC/3IABkFQ/ | FAM |
| Lwa orthogonal motif 3 | /56-FAM/TrGrCrArUrGrA/3IABkFQ/ | FAM |
| Lwa orthogonal motif 4 | /56-FAM/TrCrArUrArCrA/3IABkFQ/ | FAM |
| Lwa orthogonal motif 5 | /56-FAM/TrCrArUrArCrG/3IABkFQ/ | FAM |
| Lwa orthogonal motif 6 | /56-FAM/TrGrCrArUrArA/3IABkFQ/ | FAM |
| CcaCas13b orthogonal motif 1 | /56-FAM/TrCrUrArCrUrU/3IABkFQ/ | FAM |
| CcaCas13b orthogonal motif 2 | /56-FAM/TrCrUrArCrGrU/3IABkFQ/ | FAM |
| CcaCas13b orthogonal motif 3 | /56-FAM/TrUrUrArArArC/3IABkFQ/ | FAM |
| gold nanoparticle linker | /5ThioMC6-D/rCrUrCrCrCrUrArArUrArArCrArArUrUrArArUrArArCrUrArArUrCrCrUrArCrCrCrUrUrUrCrCrArArArArArArA/3ThioMC3-D/ | N/A |
| magnetic bead conjugate oligo | /5AmMC12/AGAGCATCACCATGATCCTGrUrUrUrUrUrUrUrUTG/iBiodT/CTCGGATATCTCGACTA/36-FAM/ | N/A |
| EiCsm6 validation motif 1 | /56-FAM/TrGrArCrGrUrG/3IABkFQ/ | N/A |
| short poly A for lateral flow | /FamCE/rArArArArArA/BioBB/ | N/A |
| long poly A for lateral flow | /FamCE/rArArArArArArArArArArA/BioBB/ | N/A |
| short poly C for lateral flow | /56-FAM/rCrCrCrCrCrC/3Bio/ | N/A |
| long poly C for lateral flow | /56-FAM/rCrCrCrCrCrCrCrCrCrCrC/3Bio/ | N/A |
| short poly A/C for lateral flow | /56-FAM/rArCrArCrArC/3Bio/ | N/A |
| long poly A/C for lateral flow | /56-FAM/rArCrArCrArCrArCrArCrArC/3Bio/ | N/A |

TABLE 27

Csm6 activators used in this study.

| Name | Sequence |
| --- | --- |
| poly A (n = 5) 2',3' cyclic phosphate end | rArArArArA-(2,3-cyclic phosphate) |
| poly A (n = 6) 2',3' cyclic phosphate end | rArArArArArA-(2,3-cyclic phosphate) |
| poly A (n = 7) 2',3' cyclic phosphate end | rArArArArArArA-(2,3-cyclic phosphate) |
| poly A (n = 8) 2',3' cyclic phosphate end | rArArArArArArArA-(2,3-cyclic phosphate) |
| Csm6 polyA polyU probes for U cutters 4 As | rArArArArUrUrUrUrU |

TABLE 28

Allele fractions of cfDNA samples used in this study.

| Patient ID | Allele fractions |
| --- | --- |
| Patient 1 | 29% L858R |
| Patient 2 | 90% exon 19 deletion |
| Patient 3 | 4% exon 19 deletion |
| Patient 4 | 2% exon 19 deletion and 0.6% T790M |
| Patient 5 | Wild Type |

TABLE 29

REPAIR plasmids used in this study.

| Plasmid Name | Description | Link to plasmid map |
| --- | --- | --- |
| REPAIR plasmid (pC0039) | CMV-dPspCas13b-GS-ADAR2DD(E488Q) | https://benchling.com/s/seq-arzpsupZEzGu3ghBDhtv |
| APC wildtype plasmid | pCMV-mScarlett-APC WT-EGFP | https://benchling.com/s/seq-w2vU03gnxluxK4OjSxiT |
| APC mutant plasmid | pCMV-mScarlett-APC mutant-EGFP | https://benchling.com/s/seq-LlmQkX8dJ4sBoZlqoxHy |
| REPAIR guide (in pC0043) | U6-guide-PspCas13b DR | https://benchling.com/s/seq-OLVAsGl655E7pTACcvl1 |
| REPAIR nontargeting guide (pC0052) | U6-nontargeting guide-PspCas13b DR | https://benchling.com/s/seq-U9gHnOW41C1DVUBGQypw |

TABLE 30

Comparison of SHERLOCKv1 and SHERLOCKv2.

| Characteristic | SHERLOCKv1 | SHERLOCKv2 |
| --- | --- | --- |
| Sensitivity | 2aM | 8zM |
| Specificity | Single-nucleotide | Single-nucleotide |
| In-sample multiplexing | Single | Up to four targets |
| Spatial multiplexing | Unlimited | Unlimited |
| Speed | 2 hours | 30 minutes (from crude sample to detection) |
| Readouts | Fluorescence | Fluorescence, visual by lateral flow |
| Signal amplification | None | Csm6 enhancement |
| Cost | <$0.60 | <$0.60 |
| Companion diagnostic | None | Paired with REPAIR for measuring RNA editing results. |
| Nuclease compatibility | Cas13a | Cas13a, Cas13b, Cas12a, and Csm6 |

REFERENCES FOR THIS EXAMPLE

1. S. Shmakov et al., Discovery and Functional Characterization of Diverse Class 2 CRISPR-Cas Systems. *Mol Cell* 6, 385-397 (2015).
2. O. O. Abudayyeh et al., C2c2 is a single-component programmable RNA-guided RNA-targeting CRISPR effector. *Science* 353, aaf5573 (2016).
3. J. S. Gootenberg et al., Nucleic acid detection with CRISPR-Ca13a/C2c2. *Science* 356, 438442 (2017).
4. A. East-Sektsky et al., Two distinct RNase activities of CRISPR-C2c2 enable guide-RNA processing and RNA detection. *Nature* 538, 270.273 (2016).
5. A. East-Sektsky, M. R. O'Connell, D. Burstein, G. J. Knott, J. A. Doudna, RNA Targeting by Functionally Orthogonal Type VI-A CRISPR-Cas Enzymes. *Mol Cell* 66, 373-38 e3 373 (2017),
6. S. Shmakov et al., Diversity and evolution of class 2 CRISPR-Cas systems. *Nat Rev Microbial* 15 169-182 (2017).
7. A. A. Smargon et al., Cas13b Is a Type VI-B CRISPR-Associated RNA-Guided RNase Differentially Regulated by Accessory Proteins Csx27 and Csx28. *Mol Cell* 65, 618-630 e6t 17 (2017).
8. J. S. Chen E. Ma. L. B. Harrington, X. Tian, J. A. Doudna. CRISPR-Cas12a target binding unleashes single-stranded DNase activity, *bioRxiv*, (2017).
9. W. H. Organization, in *Guidelines for Using HIV Testing Technologies in Surveillance: Selection, Evaluation and Implementation:* 2009 *Update*. (Geneva, 2009).
10. J. M. Barletta, D. C. Edelman, N. T. Constantine. Lowering the detection limits of HIV-1 viral load using real-time immuno-PCR for HIV-1 p24 antigen, *Am J Clin Pathol* 12, 20-27 (2004).
11. L. Deng, R. A. Garrett, S. A. Shah, X. Peng, Q. She, A novel interference mechanism by a type IIIB CRISPR-Cmr module in Sulfolobus. *Mol Microbial* 87, 1088-1099 (2013).
12. G. W. Goldberg, W. Jiang, D. Bikard, L. A. Marraffini, Conditional tolerance of temperate phages via transcription-dependent CRISPR-Cas targeting. *Nature* 514, 633-637 (2014).
13. W. Jiang, P, Samai, L. A. Marrafini, Degradation of Phage Transcripts by CRISPR-Associated RNases Enables Type III CRISPR-Cas Immunity. *Cell* 164, 710-721 (2016).
14. O. Niewoehner., M. Jinek., Structural basis for the endoribonuclease activity of the type III-A CRISPR-associated protein Csm6. *RNA* 22, 318-329 (2016).
15. P. Samai et al., Co-transcriptional DNA and RNA Cleavage during Type III CRISPR-Cas Immunity. *Cell* 161, 1164-1174 (2015).
16. R. H. Staals et al, RNA targeting by the type III-A CRISPR-Cas Csm complex of Thermus thermophilus. *Mol Cell* 56, 518-530 (2014).

17. G. Tanulaitis et al., Programmable RNA shredding by the type III-A CRISPR-Cas system of *Streptococcus thermophilus*. *Mol Cell* 56, 506-517 (2014).
18. M. Kazlauskiene, G. Kostiuk. C. Venclovas, G. Tamulaitis, V. Siksnys, A cyclic oligonucleotide signaling pathway in type III CRISPR-Cas systems. *Science* 357, 605-609 (2017).
19. O. Niewoehner et al., Type I CRISPR-Cas systems produce cyclic oligoadenylate second messengers. *Nature* 48, 543-548 (2017).
20. W. Zhao, M. M. Ali, S. D. Aguirre. M. A. Brook, Y. Li, Paper-based bioassays using gold nanoparticle colorimetric probes. *Anal Chem* 8, 8431-8437 (2008).
21 W. Zhao, J. C. Lam, W. Chiuman, M. A. Brook, Y. L. Enzymatic cleavage of nucleic acids on gold nanoparticles: a generic platform for facile colorimetric biosensors. *Small* 4, 810-816 (2008).
22. O. O. Abudayyeh et al., RNA targeting with CRISPR-Cas 13. *Nature* 550, 280-284 (2017).
23. D. B. T. Cox eat, RNA editing with CRISPR-Cas13. *Science* 358, 1019-1027 (2017).
24. S. Cottrell, D. Bicknell, L. Kaklananis, W. F. Bodmer. Molecular analysis of APC mutations in familial adenomatious polyposis and sporadic colon carcinomas. *Lancet* 340, 626-630 (1992).
25. C, Y. Chen. DNA polymerases drive DNA sequencing-by-synthesis technologies: both past and present. *Front Microbiol* 5, 305 (2014).
26. G. E. Crooks G. Hon, J. M. Chandonia, S. E. Brenner, WebLogo: a sequence logo generator. *Gnome research* 14, 1188-1190 (2004).
27. J. Ye et al., Primer-BLAST: a tool to design target-specific primers for polymerase chain reaction. *BMC Bioinformatics* 13, 134 (2012).

Example 7—Multiplexed Lateral Flow

Concept for Two-Plex Lateral Flow

This concept involves two probes: FAM-T*A*rArUG*C*-Biotin (LwaCas13a cuts) and FAM-T*A*rUrAG*C*-DIG (CcaCas13b10 cuts). These probes will bind the anti-DIG line and the streptavidin line on the dual plex lateral flow strip. One can then scan for fluorescence and detect decreases in the line intensity corresponding to collateral activity and thus target presence of target sequences. Other motifs or probes (poly A for PsmCas13b and DNA sensors for Cas12 sensing) could also be used.

Two-Plex Lateral Flow Assay for Dengue RNA and ssRNA1

In this assay, two probes were used:
FAM-T*A*rArUG*C*-Biotin (LwaCas13a cuts)—sensing ssRNA 1
FAM-T*A*rUrAG*C*-DIG (CcaCas13b10 cuts)—sensing Dengue RNA Results are shown in FIGS. 103A and 103B.

Four-Plex Lateral Flow Assay

Applicants have designed and synthesized lateral flow strips that allow for 4 lines and simultaneous detection of 4 targets.

The probes used were as follows:
/5TYE665/T*A*rArUG*C*/3AlexF488N/—LwaCas13a
/5TYE665/T*A*rUrAG*C*/36-FAM/—CcaCas13b
/5TYE665/rArArArArA/3Bio/—PsmCas13b
/5TYE665/AAAAA/3Dig N/—AsCas12a The strips contain anti-Alexa-fluor-488, anti-FAM, Streptavidin, and anti-Dig lines allowing for detection of up to 4 targets. The Tye665 dye will be sensed and decreases in line fluorescent intensity will indicate target presence.

Further embodiments are disclosed in the following numbered paragraphs:

1. A lateral flow device comprising a substrate comprising a first end, wherein the first end comprises a sample loading portion and a first region loaded with a detectable ligand, a CRISPR effector system, a detection construct, a first capture region comprising a first binding agent, and a second capture region comprising a second binding agent, wherein the CRISPR effector system comprises a CRISPR effector protein and one or more guide sequences, each guide sequence configured to bind one or more target molecules.

2. The lateral flow device of paragraph 1, wherein the detection construct comprises an RNA or DNA oligonucleotide, comprising a first molecule on a first end and a second molecule on a second end.

3. The lateral flow device of paragraphs 1 or 2, wherein the sample loading portion further comprises one or more amplification reagents to amplify the one or more target molecules.

4. The lateral flow device of paragraph 3, wherein the reagents to amplify the one or more target RNA molecules comprise nucleic acid sequence-based amplification (NASBA), recombinase polymerase amplification (RPA), loop-mediated isothermal amplification (LAMP), strand displacement amplification (SDA), helicase-dependent amplification (HDA), nicking enzyme amplification reaction (NEAR), PCR, multiple displacement amplification (MDA), rolling circle amplification (RCA), ligase chain reaction (LCR), or ramification amplification method (RAM).

5. The lateral flow device of paragraph 2, wherein the first molecule is FITC and the second molecule is biotin, or vice versa.

6. The lateral flow device of paragraph 5, wherein the first capture region is proximate to and on the same end of the lateral flow substrate as the sample loading portion.

7. The lateral flow device of paragraphs 5 or 6, wherein the first capture region comprises a first binding agent that specifically binds the first molecule of the reporter construct.

8. The lateral flow device of paragraph 7, wherein the first binding agent is an antibody that is fixed or otherwise immobilized to the first capture region.

9. The lateral flow device of any one of paragraphs 1 to 8, wherein the second capture region is located towards the opposite end of the lateral flow substrate from the first binding region.

10. The lateral flow device of paragraph 9, wherein the second capture region comprises a second binding agent that specifically binds the second molecule of the reporter construct, or the detectable ligand.

11. The lateral flow device of paragraph 10, wherein the second binding agent is an antibody or an antibody-binding protein that is fixed or otherwise immobilized to the second capture region.

12. The lateral flow device of any one of paragraphs 1-11, wherein the detectable ligand is a gold nanoparticle.

13. The lateral flow device of paragraph 12, wherein the gold nanoparticle is modified with a binding agent that specifically binds the second molecule of the detection construct.

14. The lateral flow device of paragraph 13, wherein the first antibody is an anti-FITC antibody.

15. The lateral flow device of paragraph 8, wherein the antibody is an anti-FITC antibody.

16. The lateral flow device of paragraph 8, wherein the antibody is an anti-biotin antibody.

17. The lateral flow device of any one of paragraphs 1-16, wherein the substrate is a flexible materials substrate.

18. The lateral flow device of any one of paragraphs 1-17, wherein the flexible materials substrate is a paper substrate or a flexible polymer based substrate.

19. The lateral flow device of paragraph 18, wherein the CRISPR effector protein is an RNA-targeting effector protein, a DNA-targeting protein, or a combination thereof.

20. The lateral flow device of paragraph 19, wherein the RNA-targeting effector protein is is a Cas13

21. The lateral flow device of paragraph 20, wherein the Cas13 effector protein is from anorganism of a genus selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter*, and *Lachnospira*.

22. The lateral flow device of paragraph 21, wherein the Cas13 effector protein is from an organism selected from the group consisting of: *Leptotrichia shahii; Leptotrichia wadei* (Lw2); *Listeria seeligeri; Lachnospiraceae bacterium* MA2020; *Lachnospiraceae bacterium* NK4A 179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; *Listeriaceae bacterium* FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; [*Eubacterium*] *rectale*; *Eubacteriaceae bacterium* CHKCI004; *Blautia* sp. Marseille-P2398; and *Leptotrichia* sp. oral taxon 879 str. F0557, Twelve (12) further non-limiting examples are: *Lachnospiraceae bacterium* NK4A 144; *Chloroflexus aggregans; Demequina aurantiaca; Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae; Porphyromonadaceae bacterium* KH3CP3RA; *Listeria riparia*; and *Insolitispirillum peregrinum*.

23. The lateral flow device of paragraph 22, wherein the Ca13 effector protein is a *L. wadei* F0279 or *L. wadei* F0279 (Lw2) C2c2 effector protein.

24. The lateral flow device of paragraph 19, wherein the DNA-targeting effector protein is a Cas12.

25. The lateral flow device of paragraph 24, wherein the Ca12 is Cpf1, C2c1, or a combination thereof.

26. The lateral flow device of any one of paragraphs 1 to 25, wherein the one or more guide sequences that are diagnostic for a disease state.

27. The lateral flow device of paragraph 26, wherein the disease state is cancer.

28. The lateral flow device of paragraph 26, wherein the disease state is an autoimmune disease.

29. The lateral flow device of paragraph 26, wherein the disease state is an infection.

30. The lateral flow device of paragraph 29, wherein the infection is caused by a virus, a bacterium, a fungus, a protozoan, or a parasite.

31. The lateral flow device of paragraph 30, wherein the infection is a viral infection.

32. The lateral flow device of paragraph 31, wherein the viral infection is caused by a DNA virus.

33. The lateral flow device of paragraph 32, wherein the DNA virus is a Myoviridae, Podoviridae, Siphoviridae, Alloherpesviridae, Herpesviridae (including human herpes virus, and Varicella Zorter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus.

34. The lateral flow device of paragraph 31, wherein the viral infection is caused by a double-stranded RNA virus, a positive sense RNA virus, a negative sense RNA virus, a retrovirus, or a combination thereof.

35. The lateral flow device of paragraph 34, wherein the viral infection is caused by a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus.

36. The lateral flow device of paragraph 35, wherein the viral infection is caused by Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

37. The lateral flow device of paragraph 30, wherein the infection is a bacterial infection.

38. The lateral flow device of paragraph 37, wherein the bacterium causing the bacterial infection is *Acinetobacter* species, *Actinobacillus* species, *Actinomycetes* species, an *Actinomyces* species, *Aerococcus* species an *Aeromonas* species, an *Anaplasma* species, an *Alcaligenes* species, a *Bacillus* species, a *Bacteroides* species, a *Bartonella* species, a *Bifidobacterium* species, a *Bordetella* species, a *Borrelia* species, a *Brucella* species, a *Burkholderia* species, a *Campylobacter* species, a *Capnocytophaga* species, a *Chlamydia* species, a *Citrobacter* species, a *Coxiella* species, a *Corynbacterium* species, a *Clostridium* species, an *Eikenella* species, an *Enterobacter* species, an *Escherichia* species, an *Enterococcus* species, an *Ehlichia* species, an *Epidermophyton* species, an *Erysipelothrix* species, a *Eubacterium* species, a *Francisella* species, a *Fusobacterium* species, a *Gardnerella* species, a *Gemella* species, a *Haemophilus* species, a *Helicobacter* species, a *Kingella* species, a *Klebsiella* species, a *Lactobacillus* species, a *Lactococcus* species, a *Listeria* species, a *Leptospira* species, a *Legionella* species, a *Leptospira* species, *Leuconostoc* species, a *Mannheimia* species, a *Microsporum* species, a *Micrococcus* species, a *Moraxella* species, a *Morganell* species, a *Mobiluncus* species, a *Micrococcus* species, *Mycobacterium* species, a *Mycoplasm* species, a *Nocardia* species, a *Neisseria* species, a *Pasteurelaa* species, a *Pediococcus* species, a *Peptostreptococcus* species, a *Pityrosporum* species, a *Plesiomonas* species, a *Prevotella* species, a *Porphyromonas* species, a *Proteus* species, a *Providencia* species, a *Pseudomonas* species, a *Propionibacteriums* species, a *Rhodococcus* species, a *Rickettsia* species, a *Rhodococcus* species, a *Serratia* species, a *Stenotrophomonas* species, a *Salmonella* species, a *Serratia* species, a *Shigella* species, a *Staphylococcus* species, a *Streptococcus* species, a *Spirillum* species, a *Streptobacillus* species, a *Treponema* species, a *Tropheryma* species, a *Trichophyton* species, an *Ureaplasma* species, a *Veillonella* species, a *Vibrio* species, a *Yersinia* species, a *Xanthomonas* species, or combination thereof.

39. The lateral flow device of paragraph 30, wherein the infection is caused by a fungus.

40. The lateral flow device of paragraph 39, wherein the fungus is *Aspergillus, Blastomyces, Candidiasis, Coccidiodomycosis, Cryptococcus neoformans, Cryptococcus gatti*, sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucroymcosis, Sporothrix*, fungal eye infections ringworm, *Exserohilum, Cladosporium, Geotrichum, Saccharomyces*, a *Hansenula* species, a *Candida* species, a *Kluyveromyces* species, a *Debaryomyces* species, a *Pichia* species, a *Penicillium* species, a *Cladosporium* species, a *Byssochlamys* species or a combination thereof.

41. The lateral flow device of paragraph 30, wherein the infection is caused by a protozoan.

42. The lateral flow device of paragraph 41, wherein the protozoan is *Euglenozoa*, a *Heterolobosea*, a *Diplomonadida*, an *Amoebozoa*, a *Blastocystic*, an *Apicomplexa*, or combination thereof.

43. The lateral flow device of paragraph 30, wherein the infection is caused by a parasite.

44. The lateral flow device of paragraph 43, wherein the parasite is *Trypanosoma cruzi* (Chagas disease), *T. brucei gambiense, T. brucei rhodesiense, Leishmania braziliensis, L. infantum, L. mexicana, L. major, L. tropica, L. donovani, Naegleria fowleri, Giardia intestinalis* (*G. lamblia, G. duodenalis*), *canthamoeba castellanii, Balamuthia madrillaris, Entamoeba histolytica, Blastocystic hominis, Babesia microti, Cryptosporidium parvum, Cyclospora cayetanensis, Plasmodium falciparum, P. vivax, P. ovale, P. malariae*, and *Toxoplasma gondii*, or a combination thereof.

45. The lateral flow device of any one of paragraphs 1 to 44, wherein the sample is a biological sample or an environmental sample.

46. The lateral flow device of paragraph 45, wherein the biological sample is a blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface.

47. The lateral flow device of paragraph 45, wherein the environmental sample is obtained from a food sample, paper surface, a fabric, a metal surface, a wood surface, a plastic surface, a soil sample, a fresh water sample, a waste water sample, a saline water sample, or a combination thereof.

48. The lateral flow device of paragraph 31, wherein the disease state is an infection, an organ disease, a blood disease, an immune system disease, a cancer, a brain and nervous system disease, an endocrine disease, a pregnancy or childbirth-related disease, an inherited disease, or an environmentally-acquired disease.

49. The lateral flow device of paragraph 26, wherein said disease state is characterized by the presence or absence of an antibiotic or drug resistance or susceptibility gene or transcript or polypeptide, preferably in a pathogen or a cell.

50. The lateral flow device of paragraph 49, wherein the one or more guide molecules identify a biological material.

51. The lateral flow device of paragraph 50, wherein the biological material is a genetically modified material.

52. The lateral flow device of paragraph 51, wherein the genetically modified material is a genetically modified plant.

53. The lateral flow device of paragraph 2, wherein the first molecule is FITC and the second molecule is FAM.

54. The lateral flow device of paragraph 35, wherein the viral infection is caused by Dengue fever virus.

55. A lateral flow device comprising a substrate comprising a first end, wherein the first end comprises a sample loading portion and a first region loaded with a detectable ligand, two or more CRISPR effector systems, two or more detection constructs, one or more first capture regions, each comprising a first binding agent, two or more second capture regions, each comprising a second binding agent, wherein each of the two or more CRISPR effector systems comprises a CRISPR effector protein and one or more guide sequences, each guide sequence configured to bind one or more target molecules.

56. The lateral flow device of paragraph 55, wherein each of the two or more detection construct comprises an RNA or DNA oligonucleotide, comprising a first molecule on a first end and a second molecule on a second end.

57. The lateral flow device of paragraph 56, comprising two CRISPR effector systems and two detection constructs.

58. The lateral flow device of paragraph 56, comprising four CRISPR effector systems and four detection constructs.

59. The lateral flow device of any of paragraph 55 to 58, wherein the sample loading portion further comprises one or more amplification reagents to amplify the one or more target molecules.

60. The lateral flow device of paragraph 57, wherein a first detection construct comprises FAM as a first molecule and biotin as a second molecule or vice versa and a second detection construct comprises FAM as a first molecule and Digoxigenin (DIG) as a second molecule or vice versa.

61. The lateral flow device of paragraph 60, wherein the CRISPR effector protein is an RNA-targeting effector protein.

62. The lateral flow device of paragraph 61, wherein the RNA-targeting effector protein is C2c2.

63. The lateral flow device of paragraph 19, wherein the RNA-targeting effector protein is Cas13b.

64. The lateral flow device of paragraph 58, wherein a first detection construct comprises Tye665 as a first molecule and Alexa-fluor-488 as a second molecule or vice versa; wherein a second detection construct comprises Tye665 as a first molecule and FAM as a second molecule or vice versa; wherein a third detection construct comprises Tye665 as a first molecule and biotin as a second molecule or vice versa; and wherein a fourth detection construct comprises Tye665 as a first molecule and DIG as a second molecule or vice versa.

65. The lateral flow device of paragraph 64, wherein the CRISPR effector protein is an RNA-targeting or a DNA-targeting effector protein.

66. The lateral flow device of paragraph 65, wherein the RNA targeting effector is C2c2.

67. The lateral flow device of paragraph 65, wherein the RNA targeting effector is Cas13b.

68. The lateral flow device of paragraph 65, wherein the DNA-targeting effector protein is Cas12a.

69. A method for detecting a target nucleic acid in a sample, comprising contacting a sample with the first end of the lateral flow device according to any one of paragraph 1 to 68 comprising the sample loading portion; wherein the sample flows from the sample loading portion of the substrate towards the first and second capture regions and generates a detectable signal.

70. The method of paragraph 54, wherein the sample is a liquid sample, or wherein the sample has been dissolved in an aqueous solvent.

71. The method of paragraph 54 or 55, wherein the sample does not contain target nucleic acid.

72. The method of paragraph 56, wherein the detectable signal appears at the first capture region.

73. The method of paragraph 54 or 55, wherein the sample contains target nucleic acid.

74. The method of paragraph 58, wherein the detectable signal appears at the second capture region.

75. The method of paragraph 58 or 59, wherein the presence of target nucleic acid is indicative of a disease state.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

molecule is FITC and the second molecule is biotin, or vice versa; or wherein the first molecule is FITC and the second molecule is FAM.

3. The lateral flow device of claim 1, wherein the sample loading portion further comprises one or more amplification reagents to amplify the one or more target molecules.

4. The lateral flow device of claim 3, wherein the reagents to amplify the one or more target RNA molecules comprise nucleic acid sequence-based amplification (NASBA), recombinase polymerase amplification (RPA), loop-mediated isothermal amplification (LAMP), strand displacement amplification (SDA), helicase-dependent amplification (HDA), nicking enzyme amplification reaction (NEAR), PCR, multiple displacement amplification (MDA), rolling circle amplification (RCA), ligase chain reaction (LCR), or ramification amplification method (RAM).

5. The lateral flow device of claim 2, wherein the first capture region is proximate to and on the same end of the lateral flow substrate as the sample loading portion, wherein the first capture region comprises a first binding agent that specifically binds the first molecule of the reporter construct, and wherein the first binding agent is an antibody that is fixed or otherwise immobilized to the first capture region.

6. The lateral flow device of claim 1, wherein the second capture region is located towards the opposite end of the lateral flow substrate from the first binding region, or wherein the second capture region optionally comprises a second binding agent that specifically binds the second molecule of the reporter construct, or the detectable ligand, and wherein the second binding agent is optionally an antibody or an antibody-binding protein that is fixed or otherwise immobilized to the second capture region.

7. The lateral flow device of claim 1, wherein the detectable ligand is a gold nanoparticle, wherein the gold nanoparticle is optionally modified with a binding agent that specifically binds the second molecule of the detection construct, and wherein the antibody is an anti-FITC antibody.

SEQUENCE LISTING (878 sequences)

SEQ ID NO: 1 - protein, 1434 aa, L. shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYA

SEQ ID NO: 2 - protein, 1197 aa, L. wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 3 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 4 - protein, 1340 aa, Lachnospiraceae
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 5 - protein, 1437 aa, Lachnospiraceae bacterium
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 6 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 7 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 8 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 9 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 10 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 11 - protein, 1051 aa, Listeriaceae bacterium
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 12 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 13 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 14 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 15 - protein, 1285 aa, Rhodobacter capsulatus; identical to SEQ ID NO: 14

SEQ ID NO: 16 - DNA, 47 bp, Artificial Sequence
  Synthetic Oligonucleotide
aattctaatacgactcactatagggggatcctctagaaatatggatt

SEQ ID NO: 17 - DNA, 22 bp, Artificial Sequence
  Synthetic Oligonucleotide
ctcgtatgttgtgtggaattgt

SEQ ID NO: 18 - DNA, 59 bp, Artificial Sequence
  Synthetic Oligonucleotide
aattctaatacgactcactatagggatcctctagaaatatggattacttggtagaacag

SEQ ID NO: 19 - DNA, 35 bp, Artificial Sequence
  Synthetic Oligonucleotide
gataaacacaggaaacagctatgaccatgattacg

SEQ ID NO: 20 - DNA, 54 bp, Artificial Sequence
  Synthetic Oligonucleotide
aattctaatacgactcactataggccgctgctaatgataggttgctactcacaa

SEQ ID NO: 21 - DNA, 34 bp, Artificial Sequence
  Synthetic Oligonucleotide
tcaatgtcagtcaccactattccatccacaacag

SEQ ID NO: 22 - DNA, 45 bp, Artificial Sequence
  Synthetic Oligonucleotide
gaaattaatacgactcactatagggcgtggcgcactacatgtact

SEQ ID NO: 23 - DNA, 30 bp, Artificial Sequence
  Synthetic Oligonucleotide
tgtcaatgtcagtcaccactattccatcca

SEQ ID NO: 24 - DNA, 49 bp, Artificial Sequence
  Synthetic Oligonucleotide
aattctaatacgactcactatagggtccagactcctacgggaggcwgca

SEQ ID NO: 25 - DNA, 52 bp, Artificial Sequence
  Synthetic Oligonucleotide
tttcgctctattctcatcagtttcatgtcctgtgtcattaccgcggctgctg

SEQ ID NO: 26 - DNA, 31 bp, Artificial Sequence
  Synthetic Oligonucleotide
ggtacacttcaggtatatttgaggttcattc

SEQ ID NO: 27 - DNA, 56 bp, Artificial Sequence
  Synthetic Oligonucleotide
gaaattaatacgactcactataggggttgatatgtcagagctttccagagaaataa

SEQ ID NO: 28 - DNA, 31 bp, Artificial Sequence
  Synthetic Oligonucleotide
acactaatattgattccttcagatatggact

SEQ ID NO: 29 - DNA, 55 bp, Artificial Sequence
  Synthetic Oligonucleotide
gaaattaatacgactcactatagggatcgttattcttacgcgttgtcattgaaag

SEQ ID NO: 30 - DNA, 30 bp, Artificial Sequence
  Synthetic Oligonucleotide
gaatctcttgaacccagtaggcagaggttg

SEQ ID NO: 31 - DNA, 57 bp, Artificial Sequence
  Synthetic Oligonucleotide
gaaattaatacgactcactatagggaaaggcctaagtgtccttctaccattattttg

SEQ ID NO: 32 - DNA, 32 bp, Artificial Sequence
  Synthetic Oligonucleotide
tttgtttttgatgttgttgttgtttttgtgtc

SEQ ID NO: 33 - DNA, 57 bp, Artificial Sequence
  Synthetic Oligonucleotide
gaaattaatacgactcactatagggaatgcattcatagccaaattctactggaaata

SEQ ID NO: 34 - DNA, 32 bp, Artificial Sequence
  Synthetic Oligonucleotide
gagtacgtccgcttcaccggctacccctgctc

SEQ ID NO: 35 - DNA, 57 bp, Artificial Sequence
  Synthetic Oligonucleotide
gaaattaatacgactcactatagggatagtcccctcggcgaacatggacccctacaa

SEQ ID NO: 36 - DNA, 57 bp, Artificial Sequence
  Synthetic Oligonucleotide
gaaattaatacgactcactatagggtcatgaagacctcacagtaaaaataggtgatt

SEQ ID NO: 37 - DNA, 32 bp, Artificial Sequence
  Synthetic Oligonucleotide
attcttaccatccacaaaatggatccagacaa

SEQ ID NO: 38 - DNA, 53 bp, Artificial Sequence
  Synthetic Oligonucleotide
gaaattaatacgactcactataggggcagcatgtcaagatcacagattttggg

SEQ ID NO: 39 - DNA, 29 bp, Artificial Sequence
  Synthetic Oligonucleotide
cctccttctgcatggtattctttctcttc

SEQ ID NO: 40 - DNA, 47 bp, Artificial Sequence; identical to SEQ ID NO: 16
  Synthetic Oligonucleotide

SEQ ID NO: 41 - DNA, 22 bp, Artificial Sequence
  Synthetic Oligonucleotide
ctcgtatgttgtgtggaattgt

SEQ ID NO: 42 - DNA, 49 bp, Artificial Sequence
  Synthetic Oligonucleotide
aattctaatacgactcactatagggggatcctctagaaatatggattac

SEQ ID NO: 43 - DNA, 22 bp, Artificial Sequence
  Synthetic Oligonucleotide
aaacacaggaaacagctatgac

SEQ ID NO: 44 - DNA, 49 bp, Artificial Sequence
  Synthetic Oligonucleotide
aattctaatacgactcactataggcctctagaaatatggattacttggt

SEQ ID NO: 45 - DNA, 22 bp, Artificial Sequence
  Synthetic Oligonucleotide
cgtatgttgtgtggaattgtga

SEQ ID NO: 46 - DNA, 60 bp, Artificial Sequence
  Synthetic Oligonucleotide
gaaattaatacgactcactatagggctgtcttgtctctcatggccgctggctggcttttc

SEQ ID NO: 47 - DNA, 33 bp, Artificial Sequence
  Synthetic Oligonucleotide
cgtacacaccgatggagccgccaaagtcctgtt

SEQ ID NO: 48 - DNA, 60 bp, Artificial Sequence
  Synthetic Oligonucleotide
gaaattaatacgactcactatagggagcaaatggaaactggcgaccaacggtttggcgat

SEQ ID NO: 49 - DNA, 32 bp, Artificial Sequence
  Synthetic Oligonucleotide
actgccccgaaacccggcatgtcgagatagga

SEQ ID NO: 50 - RNA, 67 nt, Artificial Sequence
  Synthetic Oligonucleotide
ggggauuuagacuaccccaaaaacgaaggggacuaaaacuagauugcuguucuaccaaguaauccau

SEQ ID NO: 51 - RNA, 28 nt, Artificial Sequence
  Synthetic Oligonucleotide
uagauugcuguucuaccaaguaauccau

SEQ ID NO: 52 - RNA, 67 nt, Artificial Sequence
  Synthetic Oligonucleotide
ggggauuuagacuaccccaaaaacgaaggggacuaaaaccauguagugcgccacgagcaaaaugaug

SEQ ID NO: 53 - RNA, 28 nt, Artificial Sequence
  Synthetic Oligonucleotide
cauguagugcgccacgagcaaaaugaug

SEQ ID NO: 54 - RNA, 67 nt, Artificial Sequence
  Synthetic Oligonucleotide
ggggauuuagacuaccccaaaaacgaaggggacuaaaacugcugccugcagcccugggaucaaguac

SEQ ID NO: 55 - RNA, 28 nt, Artificial Sequence
  Synthetic Oligonucleotide
ugcugccugcagcccugggaucaaguac

SEQ ID NO: 56 - RNA, 67 nt, Artificial Sequence
  Synthetic Oligonucleotide
ggggauuuagacuaccccaaaaacgaaggggacuaaaacacuuuacucccuuccuccccgcugaaag

SEQ ID NO: 57 - RNA, 28 nt, Artificial Sequence
  Synthetic Oligonucleotide
acuuuacucccuuccuccccgcugaaag

SEQ ID NO: 58 - RNA, 67 nt, Artificial Sequence
  Synthetic Oligonucleotide
ggggauuuagacuaccccaaaaacgaaggggacuaaaacaccucaucgccuuccuccccgcugaaag

SEQ ID NO: 59 - RNA, 28 nt, Artificial Sequence
  Synthetic Oligonucleotide
accucaucgccuuccuccccgcugaaag

SEQ ID NO: 60 - RNA, 67 nt, Artificial Sequence
  Synthetic Oligonucleotide
ggggauuuagacuaccccaaaaacgaaggggacuaaaacacuuacugcccuuccucccaacuuaaag

SEQ ID NO: 61 - RNA, 28 nt, Artificial Sequence
  Synthetic Oligonucleotide
acuuacugcccuuccucccaacuuaaag

SEQ ID NO: 62 - RNA, 67 nt, Artificial Sequence
  Synthetic Oligonucleotide
ggggauuuagacuaccccaaaaacgaaggggacuaaaacgaacccggaccuucgucgauggugaaag

SEQ ID NO: 63 - RNA, 28 nt, Artificial Sequence
  Synthetic Oligonucleotide
gaacccggaccuucgucgauggugaaag

SEQ ID NO: 64 - RNA, 67 nt, Artificial Sequence
  Synthetic Oligonucleotide
ggggauuuagacuaccccaaaaacgaaggggacuaaaacuuacacauauguucuucccuaauaacag

SEQ ID NO: 65 - RNA, 28 nt, Artificial Sequence
  Synthetic Oligonucleotide
uuacacauauguucuucccuaauaacag

SEQ ID NO: 66 - RNA, 67 nt, Artificial Sequence
  Synthetic Oligonucleotide
ggggauuuagacuaccccaaaaacgaaggggacuaaaacaugguuccgcgacgagguuggucagcgc

SEQ ID NO: 67 - RNA, 28 nt, Artificial Sequence
  Synthetic Oligonucleotide
augguuccgcgacgagguuggucagcgc

SEQ ID NO: 68 - RNA, 67 nt, Artificial Sequence
  Synthetic Oligonucleotide
ggggauuuagacuaccccaaaaacgaaggggacuaaaaccugccagacauucggugcgagcuggcgg

SEQ ID NO: 69 - RNA, 28 nt, Artificial Sequence
  Synthetic Oligonucleotide
cugccagacauucggugcgagcuggcgg

SEQ ID NO: 70 - RNA, 67 nt, Artificial Sequence
  Synthetic Oligonucleotide
ggggauuuagacuaccccaaaaacgaaggggacuaaaacaagauugcuguucuaccaaguaauccau

SEQ ID NO: 71 - RNA, 28 nt, Artificial Sequence
  Synthetic Oligonucleotide
aagauugcuguucuaccaaguaauccau

SEQ ID NO: 72 - RNA, 67 nt, Artificial Sequence
  Synthetic Oligonucleotide
ggggauuuagacuaccccaaaaacgaaggggacuaaaacuugauugcuguucuaccaaguaauccau

SEQ ID NO: 73 - RNA, 28 nt, Artificial Sequence
  Synthetic Oligonucleotide
uugauugcuguucuaccaaguaauccau

SEQ ID NO: 74 - RNA, 67 nt, Artificial Sequence
  Synthetic Oligonucleotide
ggggauuuagacuaccccaaaaacgaaggggacuaaaacuacauugcuguucuaccaaguaauccau

SEQ ID NO: 75 - RNA, 28 nt, Artificial Sequence
  Synthetic Oligonucleotide
uacauugcuguucuaccaaguaauccau

SEQ ID NO: 76 - RNA, 67 nt, Artificial Sequence
  Synthetic Oligonucleotide
ggggauuuagacuaccccaaaaacgaaggggacuaaaacuaguuugcuguucuaccaaguaauccau

SEQ ID NO: 77 - RNA, 28 nt, Artificial Sequence
  Synthetic Oligonucleotide
uaguuugcuguucuaccaaguaauccau

SEQ ID NO: 78 - RNA, 67 nt, Artificial Sequence
  Synthetic Oligonucleotide
ggggauuuagacuaccccaaaaacgaaggggacuaaaacuagaaugcuguucuaccaaguaauccau

SEQ ID NO: 79 - RNA, 28 nt, Artificial Sequence
  Synthetic Oligonucleotide
uagaaugcuguucuaccaaguaauccau

SEQ ID NO: 80 - RNA, 67 nt, Artificial Sequence
  Synthetic Oligonucleotide
ggggauuuagacuaccccaaaaacgaaggggacuaaaacuagauagcuguucuaccaaguaauccau

SEQ ID NO: 81 - RNA, 28 nt, Artificial Sequence
  Synthetic Oligonucleotide
uagauagcuguucuaccaaguaauccau

SEQ ID NO: 82 - RNA, 67 nt, Artificial Sequence
  Synthetic Oligonucleotide
ggggauuuagacuaccccaaaaacgaaggggacuaaaacuagauuccuguucuaccaaguaauccau

SEQ ID NO: 83 - RNA, 28 nt, Artificial Sequence
  Synthetic Oligonucleotide
uagauuccuguucuaccaaguaauccau

SEQ ID NO: 84 - RNA, 67 nt, Artificial Sequence
  Synthetic Oligonucleotide
ggggauuuagacuaccccaaaaacgaaggggacuaaaacuagauugguguucuaccaaguaauccau

SEQ ID NO: 85 - RNA, 28 nt, Artificial Sequence
  Synthetic Oligonucleotide
uagauugguguucuaccaaguaauccau

SEQ ID NO: 86 - RNA, 67 nt, Artificial Sequence
  Synthetic Oligonucleotide
ggggauuuagacuaccccaaaaacgaaggggacuaaaacuagauugcaguucuaccaaguaauccau

SEQ ID NO: 87 - RNA, 28 nt, Artificial Sequence
  Synthetic Oligonucleotide
uagauugcaguucuaccaaguaauccau

SEQ ID NO: 88 - RNA, 67 nt, Artificial Sequence
  Synthetic Oligonucleotide
ggggauuuagacuaccccaaaaacgaaggggacuaaaacuagauugcucuucuaccaaguaauccau

SEQ ID NO: 89 - RNA, 28 nt, Artificial Sequence
  Synthetic Oligonucleotide
uagauugcucuucuaccaaguaauccau

SEQ ID NO: 90 - RNA, 67 nt, Artificial Sequence
  Synthetic Oligonucleotide
ggggauuuagacuaccccaaaaacgaaggggacuaaaacggauacuucaugaugccagcugcuguuc

SEQ ID NO: 91 - RNA, 28 nt, Artificial Sequence
  Synthetic Oligonucleotide
ggauacuucaugaugccagcugcuguuc

SEQ ID NO: 92 - RNA, 67 nt, Artificial Sequence
  Synthetic Oligonucleotide
ggggauuuagacuaccccaaaaacgaaggggacuaaaacggauuguucaugaugccagcugcuguuc

SEQ ID NO: 93 - RNA, 28 nt, Artificial Sequence
  Synthetic Oligonucleotide
ggauuguucaugaugccagcugcuguuc

SEQ ID NO: 94 - RNA, 67 nt, Artificial Sequence
  Synthetic Oligonucleotide
ggggauuuagacuaccccaaaaacgaaggggacuaaaacggguacuucaugaugccagcugccguuc

SEQ ID NO: 95 - RNA, 28 nt, Artificial Sequence
  Synthetic Oligonucleotide
ggguacuucaugaugccagcugccguuc

SEQ ID NO: 96 - RNA, 67 nt, Artificial Sequence
  Synthetic Oligonucleotide
ggggauuuagacuaccccaaaaacgaaggggacuaaaacggguuguucaugaugccagcugccguuc

SEQ ID NO: 97 - RNA, 28 nt, Artificial Sequence
  Synthetic Oligonucleotide
ggguuguucaugaugccagcugccguuc

SEQ ID NO: 98 - RNA, 67 nt, Artificial Sequence
  Synthetic Oligonucleotide
ggggauuuagacuaccccaaaaacgaaggggacuaaaacgguuuaaucccuucugguguguugaugu

SEQ ID NO: 99 - RNA, 28 nt, Artificial Sequence
  Synthetic Oligonucleotide
gguuuaaucccuucugguguguugaugu

SEQ ID NO: 100 - RNA, 67 nt, Artificial Sequence
  Synthetic Oligonucleotide
ggggauuuagacuaccccaaaaacgaaggggacuaaaacgguaaaaucccuucugguguguugaugu

SEQ ID NO: 101 - RNA, 28 nt, Artificial Sequence
  Synthetic Oligonucleotide
gguaaaaucccuucugguguguugaugu

SEQ ID NO: 102 - RNA, 67 nt, Artificial Sequence
  Synthetic Oligonucleotide
ggggauuuagacuaccccaaaaacgaaggggacuaaaacggguuaaucccuucugguguguuuaugu

SEQ ID NO: 103 - RNA, 28 nt, Artificial Sequence
  Synthetic Oligonucleotide
ggguuaaucccuucugguguguuuaugu

SEQ ID NO: 104 - RNA, 67 nt, Artificial Sequence
  Synthetic Oligonucleotide
ggggauuuagacuaccccaaaaacgaaggggacuaaaacgggaaaaucccuucugguguguuuaugu

SEQ ID NO: 105 - RNA, 28 nt, Artificial Sequence
  Synthetic Oligonucleotide
gggaaaaucccuucugguguguuuaugu

SEQ ID NO: 106 - RNA, 62 nt, Artificial Sequence
  Synthetic Oligonucleotide
ggggauuuagacuaccccaaaaacgaaggggacuaaaacggauacuucaugaugccagcugc

SEQ ID NO: 107 - RNA, 23 nt, Artificial Sequence
  Synthetic Oligonucleotide
ggauacuucaugaugccagcugc

SEQ ID NO: 108 - RNA, 62 nt, Artificial Sequence
  Synthetic Oligonucleotide
ggggauuuagacuaccccaaaaacgaaggggacuaaaacggauuguucaugaugccagcugc

SEQ ID NO: 109 - RNA, 23 nt, Artificial Sequence
  Synthetic Oligonucleotide
ggauuguucaugaugccagcugc

SEQ ID NO: 110 - RNA, 62 nt, Artificial Sequence
  Synthetic Oligonucleotide
ggggauuuagacuaccccaaaaacgaaggggacuaaaacggguacuucaugaugccagcugc

SEQ ID NO: 111 - RNA, 23 nt, Artificial Sequence
  Synthetic Oligonucleotide
ggguacuucaugaugccagcugc

SEQ ID NO: 112 - RNA, 62 nt, Artificial Sequence
  Synthetic Oligonucleotide
ggggauuuagacuaccccaaaaacgaaggggacuaaaacggguuguucaugaugccagcugc

SEQ ID NO: 113 - RNA, 23 nt, Artificial Sequence
  Synthetic Oligonucleotide
ggguuguucaugaugccagcugc

SEQ ID NO: 114 - RNA, 67 nt, Artificial Sequence
  Synthetic Oligonucleotide
ggggauuuagacuaccccaaaaacgaaggggacuaaaacuacuacgcuucagccuacugcaaaucca

SEQ ID NO: 115 - RNA, 28 nt, Artificial Sequence
  Synthetic Oligonucleotide
uacuacgcuucagccuacugcaaaucca

SEQ ID NO: 116 - RNA, 67 nt, Artificial Sequence
  Synthetic Oligonucleotide
ggggauuuagacuaccccaaaaacgaaggggacuaaaacuauuacgcuucagccuacugcaaaucca

SEQ ID NO: 117 - RNA, 28 nt, Artificial Sequence
  Synthetic Oligonucleotide
uauuacgcuucagccuacugcaaaucca

SEQ ID NO: 118 - RNA, 67 nt, Artificial Sequence
  Synthetic Oligonucleotide
ggggauuuagacuaccccaaaaacgaaggggacuaaaacgacagaaauguccuuuucccaauccuau

SEQ ID NO: 119 - RNA, 28 nt, Artificial Sequence
  Synthetic Oligonucleotide
gacagaaauguccuuuucccaauccuau

SEQ ID NO: 120 - RNA, 67 nt, Artificial Sequence
  Synthetic Oligonucleotide
ggggauuuagacuaccccaaaaacgaaggggacuaaaacgauagaaauguccuuuucccaauccuau

SEQ ID NO: 121 - RNA, 28 nt, Artificial Sequence
  Synthetic Oligonucleotide
gauagaaauguccuuuucccaauccuau

SEQ ID NO: 122 - RNA, 67 nt, Artificial Sequence
  Synthetic Oligonucleotide
ggggauuuagacuaccccaaaaacgaaggggacuaaaacaccgacucuuuuuuguauuuccaguaga

SEQ ID NO: 123 - RNA, 28 nt, Artificial Sequence
  Synthetic Oligonucleotide
accgacucuuuuuuguauuuccaguaga

SEQ ID NO: 124 - RNA, 67 nt, Artificial Sequence
  Synthetic Oligonucleotide
ggggauuuagacuaccccaaaaacgaaggggacuaaaacacugacucuuuuuuguauuuccaguaga

SEQ ID NO: 125 - RNA, 28 nt, Artificial Sequence
  Synthetic Oligonucleotide
acugacucuuuuuuguauuuccaguaga

SEQ ID NO: 126 - RNA, 67 nt, Artificial Sequence
  Synthetic Oligonucleotide
ggggauuuagacuaccccaaaaacgaaggggacuaaaaccuacaccuucuaccaccaccuccgccag

SEQ ID NO: 127 - RNA, 28 nt, Artificial Sequence
  Synthetic Oligonucleotide
cuacaccuucuaccaccaccuccgccag

SEQ ID NO: 128 - RNA, 67 nt, Artificial Sequence
  Synthetic Oligonucleotide
ggggauuuagacuaccccaaaaacgaaggggacuaaaaccugcaccuucuaccaccaccuccgccag

SEQ ID NO: 129 - RNA, 28 nt, Artificial Sequence
  Synthetic Oligonucleotide
cugcaccuucuaccaccaccuccgccag

SEQ ID NO: 130 - RNA, 67 nt, Artificial Sequence
  Synthetic Oligonucleotide
ggggauuuagacuaccccaaaaacgaaggggacuaaaacgagagcaacaggaagcaggauuccaagu

SEQ ID NO: 131 - RNA, 28 nt, Artificial Sequence
  Synthetic Oligonucleotide
gagagcaacaggaagcaggauuccaagu

SEQ ID NO: 132 - RNA, 67 nt, Artificial Sequence
  Synthetic Oligonucleotide
ggggauuuagacuaccccaaaaacgaaggggacuaaaacgaaagcaacaggaagcaggauuccaagu

SEQ ID NO: 133 - RNA, 28 nt, Artificial Sequence
  Synthetic Oligonucleotide
gaaagcaacaggaagcaggauuccaagu

SEQ ID NO: 134 - RNA, 67 nt, Artificial Sequence
  Synthetic Oligonucleotide
ggggauuuagacuaccccaaaaacgaaggggacuaaaacccaggccaaaaucugugaucuugacaug

SEQ ID NO: 135 - RNA, 28 nt, Artificial Sequence
  Synthetic Oligonucleotide
ccaggccaaaaucugugaucuugacaug

SEQ ID NO: 136 - RNA, 67 nt, Artificial Sequence
  Synthetic Oligonucleotide
ggggauuuagacuaccccaaaaacgaaggggacuaaaaccccggccaaaaucugugaucuugacaug

SEQ ID NO: 137 - RNA, 28 nt, Artificial Sequence
  Synthetic Oligonucleotide
cccggccaaaaucugugaucuugacaug

SEQ ID NO: 138 - RNA, 67 nt, Artificial Sequence
  Synthetic Oligonucleotide
ggggauuuagacuaccccaaaaacgaaggggacuaaaacucaguguagcuagaccaaaaucaccuau

SEQ ID NO: 139 - RNA, 28 nt, Artificial Sequence
  Synthetic Oligonucleotide
ucaguguagcuagaccaaaaucaccuau

SEQ ID NO: 140 - RNA, 67 nt, Artificial Sequence
  Synthetic Oligonucleotide
ggggauuuagacuaccccaaaaacgaaggggacuaaaacucuguguagcuagaccaaaaucaccuau

SEQ ID NO: 141 - RNA, 28 nt, Artificial Sequence
  Synthetic Oligonucleotide
ucuguguagcuagaccaaaaucaccuau

SEQ ID NO: 142 - RNA, 62 nt, Artificial Sequence
  Synthetic Oligonucleotide
ggggauuuagacuaccccaaaaacgaaggggacuaaaacaagauugcuguucuaccaaguaa

SEQ ID NO: 143 - RNA, 23 nt, Artificial Sequence
  Synthetic Oligonucleotide
aagauugcuguucuaccaaguaa

SEQ ID NO: 144 - RNA, 62 nt, Artificial Sequence
  Synthetic Oligonucleotide
ggggauuuagacuaccccaaaaacgaaggggacuaaaacuugauugcuguucuaccaaguaa

SEQ ID NO: 145 - RNA, 23 nt, Artificial Sequence
  Synthetic Oligonucleotide
uugauugcuguucuaccaaguaa

SEQ ID NO: 146 - RNA, 62 nt, Artificial Sequence
  Synthetic Oligonucleotide
ggggauuuagacuaccccaaaaacgaaggggacuaaaacuaguuugcuguucuaccaaguaa

SEQ ID NO: 147 - RNA, 23 nt, Artificial Sequence
  Synthetic Oligonucleotide
uaguuugcuguucuaccaaguaa

SEQ ID NO: 148 - RNA, 62 nt, Artificial Sequence
  Synthetic Oligonucleotide
ggggauuuagacuaccccaaaaacgaaggggacuaaaacuagaaugcuguucuaccaaguaa

SEQ ID NO: 149 - RNA, 23 nt, Artificial Sequence
  Synthetic Oligonucleotide
uagaaugcuguucuaccaaguaa

SEQ ID NO: 150 - RNA, 62 nt, Artificial Sequence
  Synthetic Oligonucleotide
ggggauuuagacuaccccaaaaacgaaggggacuaaaacuagauagcuguucuaccaaguaa

SEQ ID NO: 151 - RNA, 23 nt, Artificial Sequence
  Synthetic Oligonucleotide
uagauagcuguucuaccaaguaa

SEQ ID NO: 152 - RNA, 62 nt, Artificial Sequence
  Synthetic Oligonucleotide
ggggauuuagacuaccccaaaaacgaaggggacuaaaacuagauuccuguucuaccaaguaa

SEQ ID NO: 153 - RNA, 23 nt, Artificial Sequence
  Synthetic Oligonucleotide
uagauuccuguucuaccaaguaa

SEQ ID NO: 154 - RNA, 59 nt, Artificial Sequence
  Synthetic Oligonucleotide
ggggauuuagacuaccccaaaaacgaaggggacuaaaacaagauugcuguucuaccaag

SEQ ID NO: 155 - RNA, 20 nt, Artificial Sequence
  Synthetic Oligonucleotide
aagauugcuguucuaccaag

SEQ ID NO: 156 - RNA, 59 nt, Artificial Sequence
  Synthetic Oligonucleotide
ggggauuuagacuaccccaaaaacgaaggggacuaaaacuugauugcuguucuaccaag

SEQ ID NO: 157 - RNA, 20 nt, Artificial Sequence
  Synthetic Oligonucleotide
uugauugcuguucuaccaag

SEQ ID NO: 158 - RNA, 59 nt, Artificial Sequence
  Synthetic Oligonucleotide
ggggauuuagacuaccccaaaaacgaaggggacuaaaacuaguuugcuguucuaccaag

SEQ ID NO: 159 - RNA, 20 nt, Artificial Sequence
  Synthetic Oligonucleotide
uaguuugcuguucuaccaag

SEQ ID NO: 160 - RNA, 59 nt, Artificial Sequence
  Synthetic Oligonucleotide
ggggauuuagacuaccccaaaaacgaaggggacuaaaacuagaaugcuguucuaccaag

SEQ ID NO: 161 - RNA, 20 nt, Artificial Sequence
  Synthetic Oligonucleotide
uagaaugcuguucuaccaag

SEQ ID NO: 162 - RNA, 59 nt, Artificial Sequence
  Synthetic Oligonucleotide
ggggauuuagacuaccccaaaaacgaaggggacuaaaacuagauagcuguucuaccaag

SEQ ID NO: 163 - RNA, 20 nt, Artificial Sequence
  Synthetic Oligonucleotide
uagauagcuguucuaccaag

SEQ ID NO: 164 - RNA, 59 nt, Artificial Sequence
  Synthetic Oligonucleotide
ggggauuuagacuaccccaaaaacgaaggggacuaaaacuagauuccuguucuaccaag

SEQ ID NO: 165 - RNA, 20 nt, Artificial Sequence
  Synthetic Oligonucleotide
uagauuccuguucuaccaag

SEQ ID NO: 166 - RNA, 67 nt, Artificial Sequence
  Synthetic Oligonucleotide
ggggauuuagacuaccccaaaaacgaaggggacuaaaaccuagauugcuguucuaccaaguaaucca

SEQ ID NO: 167 - RNA, 28 nt, Artificial Sequence
  Synthetic Oligonucleotide
cuagauugcuguucuaccaaguaaucca

SEQ ID NO: 168 - RNA, 67 nt, Artificial Sequence
  Synthetic Oligonucleotide
ggggauuuagacuaccccaaaaacgaaggggacuaaaacgaagauugcuguucuaccaaguaaucca

SEQ ID NO: 169 - RNA, 28 nt, Artificial Sequence
  Synthetic Oligonucleotide
gaagauugcuguucuaccaaguaaucca

SEQ ID NO: 170 - RNA, 67 nt, Artificial Sequence
  Synthetic Oligonucleotide
ggggauuuagacuaccccaaaaacgaaggggacuaaaacguugauugcuguucuaccaaguaaucca

SEQ ID NO: 171 - RNA, 28 nt, Artificial Sequence
  Synthetic Oligonucleotide
guugauugcuguucuaccaaguaaucca

SEQ ID NO: 172 - RNA, 67 nt, Artificial Sequence
  Synthetic Oligonucleotide
ggggauuuagacuaccccaaaaacgaaggggacuaaaacguaguuugcuguucuaccaaguaaucca

SEQ ID NO: 173 - RNA, 28 nt, Artificial Sequence
  Synthetic Oligonucleotide
guaguuugcuguucuaccaaguaaucca

SEQ ID NO: 174 - RNA, 67 nt, Artificial Sequence
  Synthetic Oligonucleotide
ggggauuuagacuaccccaaaaacgaaggggacuaaaacguagaaugcuguucuaccaaguaaucca

SEQ ID NO: 175 - RNA, 28 nt, Artificial Sequence
  Synthetic Oligonucleotide
guagaaugcuguucuaccaaguaaucca

SEQ ID NO: 176 - RNA, 67 nt, Artificial Sequence
  Synthetic Oligonucleotide
ggggauuuagacuaccccaaaaacgaaggggacuaaaacguagauagcuguucuaccaaguaaucca

SEQ ID NO: 177 - RNA, 28 nt, Artificial Sequence
  Synthetic Oligonucleotide
guagauagcuguucuaccaaguaaucca

SEQ ID NO: 178 - RNA, 67 nt, Artificial Sequence
  Synthetic Oligonucleotide
ggggauuuagacuaccccaaaaacgaaggggacuaaaacacuagauugcuguucuaccaaguaaucc

SEQ ID NO: 179 - RNA, 28 nt, Artificial Sequence
  Synthetic Oligonucleotide
acuagauugcuguucuaccaaguaaucc

SEQ ID NO: 180 - RNA, 67 nt, Artificial Sequence
  Synthetic Oligonucleotide
ggggauuuagacuaccccaaaaacgaaggggacuaaaacagaagauugcuguucuaccaaguaaucc

SEQ ID NO: 181 - RNA, 28 nt, Artificial Sequence
  Synthetic Oligonucleotide
agaagauugcuguucuaccaaguaaucc

SEQ ID NO: 182 - RNA, 67 nt, Artificial Sequence
  Synthetic Oligonucleotide
ggggauuuagacuaccccaaaaacgaaggggacuaaaacaguugauugcuguucuaccaaguaaucc

SEQ ID NO: 183 - RNA, 28 nt, Artificial Sequence
  Synthetic Oligonucleotide
aguugauugcuguucuaccaaguaaucc

SEQ ID NO: 184 - RNA, 67 nt, Artificial Sequence
  Synthetic Oligonucleotide
ggggauuuagacuaccccaaaaacgaaggggacuaaaacaguaguuugcuguucuaccaaguaaucc

SEQ ID NO: 185 - RNA, 28 nt, Artificial Sequence
  Synthetic Oligonucleotide
aguaguuugcuguucuaccaaguaaucc

SEQ ID NO: 186 - RNA, 67 nt, Artificial Sequence
  Synthetic Oligonucleotide
ggggauuuagacuaccccaaaaacgaaggggacuaaaacaguagaaugcuguucuaccaaguaaucc

SEQ ID NO: 187 - RNA, 28 nt, Artificial Sequence
  Synthetic Oligonucleotide
aguagaaugcuguucuaccaaguaaucc

SEQ ID NO: 188 - RNA, 67 nt, Artificial Sequence
  Synthetic Oligonucleotide
ggggauuuagacuaccccaaaaacgaaggggacuaaaacaguagauagcuguucuaccaaguaaucc

SEQ ID NO: 189 - RNA, 28 nt, Artificial Sequence
  Synthetic Oligonucleotide
aguagauagcuguucuaccaaguaaucc

SEQ ID NO: 190 - RNA, 67 nt, Artificial Sequence
  Synthetic Oligonucleotide
ggggauuuagacuaccccaaaaacgaaggggacuaaaacgacuagauugcuguucuaccaaguaauc

SEQ ID NO: 191 - RNA, 28 nt, Artificial Sequence
  Synthetic Oligonucleotide
gacuagauugcuguucuaccaaguaauc

SEQ ID NO: 192 - RNA, 67 nt, Artificial Sequence
  Synthetic Oligonucleotide
ggggauuuagacuaccccaaaaacgaaggggacuaaaacgagaagauugcuguucuaccaaguaauc

SEQ ID NO: 193 - RNA, 28 nt, Artificial Sequence
  Synthetic Oligonucleotide
gagaagauugcuguucuaccaaguaauc

SEQ ID NO: 194 - RNA, 67 nt, Artificial Sequence
  Synthetic Oligonucleotide
ggggauuuagacuaccccaaaaacgaaggggacuaaaacgaguugauugcuguucuaccaaguaauc

SEQ ID NO: 195 - RNA, 28 nt, Artificial Sequence
  Synthetic Oligonucleotide
gaguugauugcuguucuaccaaguaauc

SEQ ID NO: 196 - RNA, 67 nt, Artificial Sequence
  Synthetic Oligonucleotide
ggggauuuagacuaccccaaaaacgaaggggacuaaaacgaguaguuugcuguucuaccaaguaauc

SEQ ID NO: 197 - RNA, 28 nt, Artificial Sequence
  Synthetic Oligonucleotide
gaguaguuugcuguucuaccaaguaauc

SEQ ID NO: 198 - RNA, 67 nt, Artificial Sequence
  Synthetic Oligonucleotide
ggggauuuagacuaccccaaaaacgaaggggacuaaaacgaguagaaugcuguucuaccaaguaauc

SEQ ID NO: 199 - RNA, 28 nt, Artificial Sequence
  Synthetic Oligonucleotide
gaguagaaugcuguucuaccaaguaauc

SEQ ID NO: 200 - RNA, 67 nt, Artificial Sequence
  Synthetic Oligonucleotide
ggggauuuagacuaccccaaaaacgaaggggacuaaaacgaguagauagcuguucuaccaaguaauc

SEQ ID NO: 201 - RNA, 28 nt, Artificial Sequence
  Synthetic Oligonucleotide
gaguagauagcuguucuaccaaguaauc

SEQ ID NO: 202 - RNA, 176 nt, Artificial Sequence
  Synthetic Oligonucleotide
gggggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacacaacauacgagccggaagcauaaag

SEQ ID NO: 203 - RNA, 176 nt, Artificial Sequence
  Synthetic Oligonucleotide
gggggccagugaauucgagcucgguacccggggauccucuagaaauauggauuacuugguagaacagcaaucuagucgaccugcaggcaugcaagcuuggcguaaucauggucauagcuguuuccuguguuuauccgcucacaauuccacacaacauacgagccggaagcauaaag

SEQ ID NO: 204 - RNA, 176 nt, Artificial Sequence
  Synthetic Oligonucleotide
gggggccagugaauucgagcucgguacccggggauccucuagaaauauggauuacuugguagaacagcaaucuaaucgaccugcaggcaugcaagcuuggcguaaucauggucauagcuguuuccuguguuuauccgcucacaauuccacacaacauacgagccggaagcauaaag

SEQ ID NO: 205 - RNA, 176 nt, Artificial Sequence
  Synthetic Oligonucleotide
gggggccagugaauucgagcucgguacccggggauccucuagaaauauggauuacuugguagaacagcaaucuauucgaccugcaggcaugcaagcuuggcguaaucauggucauagcuguuuccuguguuuauccgcucacaauuccacacaacauacgagccggaagcauaaag

SEQ ID NO: 206 - DNA, 173 bp, Artificial Sequence
  Synthetic Oligonucleotide
ggccagtgaattcgagctcggtacccggggatcctctagaaatatggattacttggtagaacagcaatctactcgacctgcaggcatgcaagcttggcgtaatcatggtcatagctgtttcctgtgtttatccgctcacaattccacacaacatacgagccggaagcataaag

SEQ ID NO: 207 - DNA, 189 bp, Artificial Sequence
  Synthetic Oligonucleotide
gagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactat

SEQ ID NO: 208 - RNA, 334 nt, Zika virus
agcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccaua

SEQ ID NO: 209 - RNA, 334 nt, Dengue virus
ggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccuc

SEQ ID NO: 210 - RNA, 337 nt, Artificial Sequence
  Synthetic Oligonucleotide
gggagcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccaua

SEQ ID NO: 211 - RNA, 173 nt, Artificial Sequence
  Synthetic Oligonucleotide
gggaaccuugauaguggcuaucauucugcuuguggcacacuauauguacuugaucccaggccuacaggcagcagcagcgcgugcugcccagaagagaacagcagcuggcaucaugaagaaucccguuguggauggaauagugguaacugacauugacacaaugacaauugacc

SEQ ID NO: 212 - RNA, 173 nt, Artificial Sequence
  Synthetic Oligonucleotide
ggggacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacc

SEQ ID NO: 213 - RNA, 136 nt, Artificial Sequence
  Synthetic Oligonucleotide
gggaguacauauucaggggccaaccucucaacaaugacgaagaccaugcucacuggacagaagcaaaaaugcugcuggacaacaucaacacaccagaagggauuauaccagcucucuuugaaccagaaagggagaa

SEQ ID NO: 214 - RNA, 173 nt, Artificial Sequence
  Synthetic Oligonucleotide
gggaguacauuuacaugggacagccuucaaacaacgaugaggaucacgcucauuggacagaagcaaaaaugcuccuugacaacauaaacacaccagaagggauuaucccagcccucuuugagccggagagaggaaaaagugcagcaauagacggggaauacagacugcggggu

SEQ ID NO: 215 - RNA, 176 nt, Artificial Sequence
  Synthetic Oligonucleotide
gggggccagugaauucgagcucgguacccggggauccucuagaaauauggauuacuugguagaacagcaauguacucgaccugcaggcaugcaagcuuggcguaaucauggucauagcuguuuccuguguuuauccgcucacaauuccacacaacauacgagccggaagcauaaag

SEQ ID NO: 216 - RNA, 176 nt, Artificial Sequence
  Synthetic Oligonucleotide
gggggccagugaauucgagcucgguacccggggauccucuagaaauauggauuacuugguagaacagcuauguacucgaccugcaggcaugcaagcuuggcguaaucauggucauagcuguuuccuguguuuauccgcucacaauuccacacaacauacgagccggaagcauaaag

SEQ ID NO: 217 - DNA, 22 bp, Artificial Sequence
  Synthetic Oligonucleotide
gtggaattgtgagcggataaac

SEQ ID NO: 218 - DNA, 21 bp, Artificial Sequence
  Synthetic Oligonucleotide
aacagcaatctactcgacctg

SEQ ID NO: 219 - DNA, 28 bp, Artificial Sequence
  Synthetic Probe
  misc_feature (1)..(1): FAM dye
  misc_feature (9)..(10): ZEN quencher
  misc_feature (28)..(28): 3' 3IABkFQ tag
aggaaacagctatgaccatgattacgcc

SEQ ID NO: 220 - RNA, 64 nt, Leptotrichia wadei
  misc_feature (37)..(64): n = any nucleotide
gauuuagacuaccccaaaaagcaaggggacuaaaacnnnnnnnnnnnnnnnnnnnnnnnnnnnn

SEQ ID NO: 221 - RNA, 56 nt, Leptotrichia wadei
  misc_feature (29)..(56): n = any nucleotide
ccaccccaauaucgaaggggacuaaaacnnnnnnnnnnnnnnnnnnnnnnnnnnnn

SEQ ID NO: 222 - RNA, 70 nt, Artificial Sequence
  Synthetic Oligonucleotide
uacccggggauccucuagaaauauggauuacuugguagaacagcaaucuacucgaccugcaggcaugcaa

SEQ ID NO: 223 - DNA, 44 bp, Artificial Sequence
  Synthetic Oligonucleotide
gcaaggggactaaaacuagauugcuguucuaccaaguaauccau

SEQ ID NO: 224 - DNA, 10 bp, Artificial Sequence
  Synthetic Oligonucleotide
tagattgctg

SEQ ID NO: 225 - DNA, 10 bp, Artificial Sequence
  Synthetic Oligonucleotide
aagattgctg

SEQ ID NO: 226 - DNA, 10 bp, Artificial Sequence
  Synthetic Oligonucleotide
ttgattgctg

SEQ ID NO: 227 - DNA, 10 bp, Artificial Sequence
  Synthetic Oligonucleotide
tacattgctg

SEQ ID NO: 228 - DNA, 10 bp, Artificial Sequence
  Synthetic Oligonucleotide
tagtttgctg

SEQ ID NO: 229 - DNA, 10 bp, Artificial Sequence
  Synthetic Oligonucleotide
tagaatgctg

SEQ ID NO: 230 - DNA, 10 bp, Artificial Sequence
  Synthetic Oligonucleotide
tagatagctg

SEQ ID NO: 231 - DNA, 10 bp, Artificial Sequence
  Synthetic Oligonucleotide
tagattcctg

SEQ ID NO: 232 - DNA, 10 bp, Artificial Sequence
  Synthetic Oligonucleotide
tagattggtg

SEQ ID NO: 233 - DNA, 10 bp, Artificial Sequence
  Synthetic Oligonucleotide
tagattgcag

SEQ ID NO: 234 - DNA, 10 bp, Artificial Sequence
  Synthetic Oligonucleotide
tagattgctc

SEQ ID NO: 235 - DNA, 10 bp, Artificial Sequence
  Synthetic Oligonucleotide
atctaacgac

SEQ ID NO: 236 - DNA, 10 bp, Artificial Sequence
  Synthetic Oligonucleotide
atgtaacgac

SEQ ID NO: 237 - DNA, 10 bp, Artificial Sequence
  Synthetic Oligonucleotide
atgtatcgac

SEQ ID NO: 238 - RNA, 58 nt, Artificial Sequence
  Synthetic Oligonucleotide
gugcugcccagaagagaacagcagcuggcaucaugaagaaucccguuguggauggaau

SEQ ID NO: 239 - RNA, 63 nt, Artificial Sequence
  Synthetic Oligonucleotide
gauuuagacuaccccaaaaagcaaggggacuaaaacggauacucaugaugccagcugcuguuc

SEQ ID NO: 240 - RNA, 58 nt, Artificial Sequence; identical to SEQ ID NO: 238
  Synthetic Oligonucleotide

SEQ ID NO: 241 - RNA, 64 nt, Artificial Sequence
  Synthetic Oligonucleotide
gauuuagacuaccccaaaaagcaaggggacuaaaacggauacuucaugaugccagcugcuguuc

SEQ ID NO: 242 - RNA, 58 nt, Artificial Sequence
  Synthetic Oligonucleotide
gugcugcccagaagagaacggcagcuggcaucaugaagaaccccguuguggauggaau

SEQ ID NO: 243 - RNA, 58 nt, Zika virus; identical to SEQ ID NO: 238

SEQ ID NO: 244 - RNA, 28 nt, Zika virus
ggauuguucaugaugccagcugcuguuc

SEQ ID NO: 245 - RNA, 28 nt, Zika virus
ggauacuucaugaugccagcugcuguuc

SEQ ID NO: 246 - RNA, 58 nt, Zika virus
gugcugcccagaagagaacggcagcuggcaucaugaagaacccuguuguggauggaau

SEQ ID NO: 247 - RNA, 28 nt, Zika virus
ggguacuucaugaugccagcugccguuc

SEQ ID NO: 248 - RNA, 28 nt, Zika virus
ggguuguucaugaugccagcugccguuc

SEQ ID NO: 249 - RNA, 58 nt, Dengue virus
aaaugcugcuggacaacaucaacacaccagaagggauuauaccagcucucuuugaacc

SEQ ID NO: 250 - RNA, 28 nt, Dengue virus
gguaaaaucccuucugguguguugaugu

SEQ ID NO: 251 - RNA, 28 nt, Dengue virus
gguuuaaucccuucugguguguugaugu

SEQ ID NO: 252 - RNA, 58 nt, Dengue virus
aaaugcuccuugacaacauaaacacaccagaagggauuaucccagcccucuuugagcc

SEQ ID NO: 253 - RNA, 28 nt, Dengue virus
ggguuaaucccuucugguguguuuaugu

SEQ ID NO: 254 - RNA, 28 nt, Dengue virus
gggaaaaucccuucugguguguuuaugu

SEQ ID NO: 255 - RNA, 39 nt, Homo sapiens
caccgcagcaugucaagaucacagauuuugggcgggcca

SEQ ID NO: 256 - RNA, 28 nt, Homo sapiens
cccggccaaaaucugugaucuugacaug

SEQ ID NO: 257 - RNA, 28 nt, Homo sapiens
ccaggccaaaaucugugaucuugacaug

SEQ ID NO: 258 - RNA, 39 nt, Homo sapiens
caguaaaaauaggugauuuuggucuagcuacagagaaau

SEQ ID NO: 259 - RNA, 28 nt, Homo sapiens
ucuguguagcuagaccaaaaucaccuau

SEQ ID NO: 260 - RNA, 28 nt, Homo sapiens
ucagugaugcuagaccaaaaucaccuau

SEQ ID NO: 261 - DNA, 57 bp, Artificial Sequence
  Synthetic Oligonucleotide
tgtggttggtgtggttggttcatggtcatattggttttttccaaccacagtctctgt

SEQ ID NO: 262 - DNA, 82 bp, Artificial Sequence
  Synthetic Oligonucleotide
tgtggttggtgtggttggttcatggtcatattggttttttccaaccacagtctctgtggttggtagtctcgaattgctctct

SEQ ID NO: 263 - protein, 18 aa, Leptotrichia shahii
IRKFIKIGTNERNRILHA

SEQ ID NO: 264 - protein, 15 aa, Leptotrichia shahii
SIRNYISHFYIVRNP

SEQ ID NO: 265 - protein, 18 aa, Lachnospiraceae bacterium
LYSLKSMLYSMRNSSFHF

SEQ ID NO: 266 - protein, 15 aa, Lachnospiraceae bacterium
IFRNEIDHFHYFYDR

SEQ ID NO: 267 - protein, 18 aa, Lachnospiraceae
LTDLKDVIYSMRNDSFHY

SEQ ID NO: 268 - protein, 15 aa, Lachnospiraceae
ELRNYIEHFRYYSSF

SEQ ID NO: 269 - protein, 18 aa, Clostridium aminophilum
ADDLRKAIYSLRNETFHF

SEQ ID NO: 270 - protein, 15 aa, Clostridium aminophilum
DVRKYVDHFKYYATS

SEQ ID NO: 271 - protein, 18 aa, Carnobacterium gallinarum
IWALRGSVQQIRNEIFHS

SEQ ID NO: 272 - protein, 15 aa, Carnobacterium gallinarum
KIRNQTAHLSVLQLE

SEQ ID NO: 273 - protein, 18 aa, Carnobacterium gallinarum
LWAIRGAVQRVRNQIFHQ

SEQ ID NO: 274 - protein, 15 aa, Carnobacterium gallinarum
EIRNNIAHLHVLRND

SEQ ID NO: 275 - protein, 18 aa, Paludibacter proprionicigenes
LWGIRGAVQQIRNNVNHY

SEQ ID NO: 276 - protein, 15 aa, Paludibacter proprionicigenes
DIRNHIAHFNYLTKD

SEQ ID NO: 277 - protein, 18 aa, Listeria weihenstephanensis
IWAIRGSIQQIRNEVYHC

SEQ ID NO: 278 - protein, 15 aa, Listeria weihenstephanensis
NARNHIAHLNYLSLK

SEQ ID NO: 279 - protein, 18 aa, Listeriaceae bacterium
IWAIRGSIQQIRNEVYHC

SEQ ID NO: 280 - protein, 15 aa, Listeriaceae bacterium
NARNHIAHLNYLSLK

SEQ ID NO: 281 - protein, 18 aa, Leptotrichia wadei
FANIDEAISSIRHGIVHF

SEQ ID NO: 282 - protein, 15 aa, Leptotrichia wadei
YIRNYIAHFNYIPHA

SEQ ID NO: 283 - protein, 18 aa, Rodobacter capsulatus
VFALLRYLRGCRNQTFHL

SEQ ID NO: 284 - protein, 15 aa, Rhodobacter capsulatus
QTRKDLAHFNVLDRA

SEQ ID NO: 285 - protein, 18 aa, Rhodobacter capsulatus
VFALLRYLRGCRNQTFHL

SEQ ID NO: 286 - protein, 15 aa, Rhodobacter capsulatus
QTRKDLAHFNVLDRA

SEQ ID NO: 287 - protein, 18 aa, Rhodobacter capsulatus
VFALLRYLRGCRNQTFHL

SEQ ID NO: 288 - protein, 15 aa, Rhodobacter capsulatus
QTRKDLAHFNVLDRA

SEQ ID NO: 289 - protein, 18 aa, L wadei
FANIDEAISSIRHGIVHF

SEQ ID NO: 290 - protein, 15 aa, L wadei
YIRNYIAHFNYIPHA

SEQ ID NO: 291 - protein, 18 aa, Listeria seeligeri
SWGLRGAIAPIRNEIIHL

SEQ ID NO: 292 - protein, 15 aa, Listeria seeligeri
EKRNNISHFNYLNGQ

SEQ ID NO: 293 - RNA, 64 nt, Artificial Sequence
  Synthetic Oligonucleotide
gauuuagacuaccccaaaaagcaaggggacuaaaacuagauugcuguucuaccaaguaauccau

SEQ ID NO: 294 - RNA, 23 nt, Artificial Sequence
  Synthetic Oligonucleotide
uagauugcuguucuaccaaguaa

SEQ ID NO: 295 - RNA, 20 nt, Artificial Sequence
  Synthetic Oligonucleotide
uagauugcuguucuaccaag

SEQ ID NO: 296 - RNA, 28 nt, Artificial Sequence
  Synthetic Oligonucleotide
auggauuacuugguagaacagcaaucua

SEQ ID NO: 297 - RNA, 28 nt, Artificial Sequence
  Synthetic Oligonucleotide
auggauuacuugguagaacagcaaugua

SEQ ID NO: 298 - RNA, 17 nt, Artificial Sequence
  Synthetic Oligonucleotide
uagauugcuguucuacc

SEQ ID NO: 299 - RNA, 17 nt, Artificial Sequence
  Synthetic Oligonucleotide
aagauugcuguucuacc

SEQ ID NO: 300 - RNA, 17 nt, Artificial Sequence
  Synthetic Oligonucleotide
uugauugcuguucuacc

SEQ ID NO: 301 - RNA, 17 nt, Artificial Sequence
  Synthetic Oligonucleotide
uaguuugcuguucuacc

SEQ ID NO: 302 - RNA, 17 nt, Artificial Sequence
  Synthetic Oligonucleotide
uagaaugcuguucuacc

SEQ ID NO: 303 - RNA, 17 nt, Artificial Sequence
  Synthetic Oligonucleotide
uagauagcuguucuacc

SEQ ID NO: 304 - RNA, 17 nt, Artificial Sequence
  Synthetic Oligonucleotide
uagauuccuguucuacc

SEQ ID NO: 305 - RNA, 30 nt, Artificial Sequence
  Synthetic Oligonucleotide
auggauuacuuggugaacagcaaucuacuc

SEQ ID NO: 306 - RNA, 32 nt, Artificial Sequence
  Synthetic Oligonucleotide
auggauuacuugguagaacagcaauguuacuc

SEQ ID NO: 307 - RNA, 28 nt, Artificial Sequence
  Synthetic Oligonucleotide
aagauugcuguucuaccaaguaauccau

SEQ ID NO: 308 - RNA, 28 nt, Artificial Sequence
  Synthetic Oligonucleotide
uugauugcuguucuaccaaguaauccau

SEQ ID NO: 309 - RNA, 28 nt, Artificial Sequence
  Synthetic Oligonucleotide
uaguuugcuguucuaccaaguaauccau

SEQ ID NO: 310 - RNA, 28 nt, Artificial Sequence
  Synthetic Oligonucleotide
uagaaugcuguucuaccaaguaauccau

SEQ ID NO: 311 - RNA, 28 nt, Artificial Sequence
  Synthetic Oligonucleotide
uagauagcuguucuaccaaguaauccau

SEQ ID NO: 312 - RNA, 28 nt, Artificial Sequence
  Synthetic Oligonucleotide
uagauuccuguucuaccaaguaauccau

SEQ ID NO: 313 - RNA, 31 nt, Artificial Sequence
  Synthetic Oligonucleotide
auggauaucuugguagaacagcaaucuacuc

SEQ ID NO: 314 - RNA, 31 nt, Artificial Sequence
  Synthetic Oligonucleotide
auggauuacuugguagaacagcaauguacuc

SEQ ID NO: 315 - RNA, 28 nt, Artificial Sequence
  Synthetic Oligonucleotide
cuagauugcuguucuaccaaguaaucca

SEQ ID NO: 316 - RNA, 28 nt, Artificial Sequence
  Synthetic Oligonucleotide
gaagauugcuguucuaccaaguaaucca

SEQ ID NO: 317 - RNA, 28 nt, Artificial Sequence
  Synthetic Oligonucleotide
guugauugcuguucuaccaaguaaucca

SEQ ID NO: 318 - RNA, 28 nt, Artificial Sequence
  Synthetic Oligonucleotide
guaguuugcuguucuaccaaguaaucca

SEQ ID NO: 319 - RNA, 28 nt, Artificial Sequence
  Synthetic Oligonucleotide
guagaaugcuguucuaccaaguaaucca

SEQ ID NO: 320 - RNA, 28 nt, Artificial Sequence
  Synthetic Oligonucleotide
guagauagcuguucuaccaaguaaucca

SEQ ID NO: 321 - RNA, 31 nt, Artificial Sequence
  Synthetic Oligonucleotide
auggauuacuugguagaacagcaaucuacuc

SEQ ID NO: 322 - RNA, 31 nt, Artificial Sequence; identical to SEQ ID NO: 314
  Synthetic Oligonucleotide

SEQ ID NO: 323 - RNA, 28 nt, Artificial Sequence
  Synthetic Oligonucleotide
acuagauugcuguucuaccaaguaaucc

SEQ ID NO: 324 - RNA, 28 nt, Artificial Sequence
  Synthetic Oligonucleotide
agaagauugcuguucuaccaaguaaucc

SEQ ID NO: 325 - RNA, 28 nt, Artificial Sequence
  Synthetic Oligonucleotide
aguugauugcuguucuaccaaguaaucc

SEQ ID NO: 326 - RNA, 28 nt, Artificial Sequence
  Synthetic Oligonucleotide
aguaguuugcuguucuaccaaguaaucc

SEQ ID NO: 327 - RNA, 28 nt, Artificial Sequence
  Synthetic Oligonucleotide
aguagaaugcuguucuaccaaguaaucc

SEQ ID NO: 328 - RNA, 28 nt, Artificial Sequence
  Synthetic Oligonucleotide
aguagauagcuguucuaccaaguaaucc

SEQ ID NO: 329 - RNA, 31 nt, Artificial Sequence; identical to SEQ ID NO: 321
  Synthetic Oligonucleotide

SEQ ID NO: 330 - RNA, 31 nt, Artificial Sequence; identical to SEQ ID NO: 314
  Synthetic Oligonucleotide

SEQ ID NO: 331 - RNA, 28 nt, Artificial Sequence
  Synthetic Oligonucleotide
gacuagauugcuguucuaccaaguaauc

SEQ ID NO: 332 - RNA, 28 nt, Artificial Sequence
  Synthetic Oligonucleotide
gagaagauugcuguucuaccaaguaauc

SEQ ID NO: 333 - RNA, 28 nt, Artificial Sequence
  Synthetic Oligonucleotide
gaguugauugcuguucuaccaaguaauc

SEQ ID NO: 334 - RNA, 28 nt, Artificial Sequence
  Synthetic Oligonucleotide
gaguaguuugcuguucuaccaaguaauc

SEQ ID NO: 335 - RNA, 28 nt, Artificial Sequence
  Synthetic Oligonucleotide
gaguagaaugcuguucuaccaaguaauc

SEQ ID NO: 336 - RNA, 28 nt, Artificial Sequence
  Synthetic Oligonucleotide
gaguagauagcuguucuaccaaguaauc

SEQ ID NO: 337 - DNA, 57 bp, Artificial Sequence
  Synthetic Oligonucleotide
gaaattaatacgactcactatagggttattgcaattattaatcttgaacgaggaatg

SEQ ID NO: 338 - DNA, 57 bp, Artificial Sequence
  Synthetic Oligonucleotide
gaaattaatacgactcactataggggattgacagattaatagctctttcttgatttc

SEQ ID NO: 339 - DNA, 32 bp, Artificial Sequence
  Synthetic Oligonucleotide
atttttcttgtccaaacaattcatcatatctt

SEQ ID NO: 340 - DNA, 32 bp, Artificial Sequence
  Synthetic Oligonucleotide
ttcaatttcaaataagaatatagtgtactcgc

SEQ ID NO: 341 - DNA, 57 bp, Artificial Sequence
  Synthetic Oligonucleotide
gaaattaatacgactcactatagggttcttattagcagaacaaagaagtttaacaac

SEQ ID NO: 342 - DNA, 57 bp, Artificial Sequence
  Synthetic Oligonucleotide
gaaattaatacgactcactatagggattttatgcaatgttaaaaactgttccaagta

SEQ ID NO: 343 - DNA, 32 bp, Artificial Sequence
  Synthetic Oligonucleotide
taattgacatccaatccataataaagcataga

SEQ ID NO: 344 - DNA, 32 bp, Artificial Sequence
  Synthetic Oligonucleotide
gaattatagttgttaaacttctttgttctgct

SEQ ID NO: 345 - DNA, 89 bp, Artificial Sequence
  Synthetic Oligonucleotide
cctagtaagcatgattcatcagattgtggttttagtccccttcgtttttggggtagtctaaatcccctatagtgagtcgtattaatttc

SEQ ID NO: 346 - DNA, 89 bp, Artificial Sequence
  Synthetic Oligonucleotide
ggatggtgatgcatggccgtttttagttgttttagtccccttcgtttttggggtagtctaaatcccctatagtgagtcgtattaatttc

SEQ ID NO: 347 - DNA, 89 bp, Artificial Sequence
  Synthetic Oligonucleotide
caatttaaaatgatttttggtgctagaggttttagtccccttcgtttttggggtagtctaaatcccctatagtgagtcgtattaatttc

SEQ ID NO: 348 - DNA, 89 bp, Artificial Sequence
  Synthetic Oligonucleotide
gctggtttagtaattgtattattatcatgttttagtccccttcgtttttggggtagtctaaatcccctatagtgagtcgtattaatttc

SEQ ID NO: 349 - DNA, 173 bp, Artificial Sequence; identical to SEQ ID NO: 206
  Synthetic Oligonucleotide

SEQ ID NO: 350 - DNA, 173 bp, Artificial Sequence
  Synthetic Oligonucleotide
ccggtcacttaagctcgagccatgggcccctaggagatctttatacctaatgaaccatcttgtcgttagatgagctggacgtccgtacgttcgaaccgcattatgaccagtatcgacaaaggacacaaataggcgagtgttaaggtgtgttgtatgctcggccttcgtatttc

SEQ ID NO: 351 - protein, 6 aa, Artificial Sequence
  Synthetic Peptide
  MISC_FEATURE (2)..(2): Xaa = N or H or K
  MISC_FEATURE (3)..(3): Xaa = R, S, D, E, Q, N, G, Y, or H
  MISC_FEATURE (4)..(4): Xaa = I, S, T, V, or L
  MISC_FEATURE (5)..(5): Xaa = L, F, N, Y, V, I, S, D, E, or A
RXXXXH

SEQ ID NO: 352 - protein, 6 aa, Artificial Sequence
  Synthetic Peptide
  MISC_FEATURE (2)..(2): Xaa = N or H
  MISC_FEATURE (3)..(3): Xaa = R, S, D, E, Q, N, G, Y, or H
  MISC_FEATURE (4)..(4): Xaa = I, S, T, V, or L
  MISC_FEATURE (5)..(5): Xaa = L, F, N, Y, V, I, S, D, E, or A
RXXXXH

SEQ ID NO: 353 - protein, 6 aa, Artificial Sequence
  Synthetic Peptide
  MISC_FEATURE (2)..(2): Xaa = N or K
  MISC_FEATURE (3)..(3): Xaa = R, S, D, E, Q, N, G, Y, or H
  MISC_FEATURE (4)..(4): Xaa = I, S, T, V, or L
  MISC_FEATURE (5)..(5): Xaa = L, F, N, Y, V, I, S, D, E, or A
RXXXXH

SEQ ID NO: 354 - protein, 1159 aa, Leptorichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 355 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 356 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 357 - protein, 1373 aa, Eubacteriaceae bacterium
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 358 - protein, 1276 aa, Blautia species
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 359 - protein, 1385 aa, Leptotrichia species
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 360 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 361 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 362 - protein, 1235 aa, Thalassospira species
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 363 - protein, 1312 aa, Pseudobutyrivibrio species
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 364 - protein, 1276 aa, Blautia species; identical to SEQ ID NO: 358

SEQ ID NO: 365 - protein, 1168 aa, Leptotrichia species
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 366 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 367 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 368 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 369 - protein, 1001 aa, Artificial Sequence
  Synthetic Peptide
  misc_feature (7)..(9): Xaa can be any naturally occurring amino acid
  misc_feature (11)..(11): Xaa can be any naturally occurring amino acid
  misc_feature (14)..(16): Xaa can be any naturally occurring amino acid
  misc_feature (20)..(20): Xaa can be any naturally occurring amino acid
  misc_feature (22)..(22): Xaa can be any naturally occurring amino acid
  misc_feature (29)..(29): Xaa can be any naturally occurring amino acid
  misc_feature (36)..(36): Xaa can be any naturally occurring amino acid
  misc_feature (42)..(43): Xaa can be any naturally occurring amino acid
  misc_feature (48)..(48): Xaa can be any naturally occurring amino acid
  misc_feature (52)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (69)..(71): Xaa can be any naturally occurring amino acid
  misc_feature (73)..(73): Xaa can be any naturally occurring amino acid
  misc_feature (75)..(75): Xaa can be any naturally occurring amino acid
  misc_feature (78)..(79): Xaa can be any naturally occurring amino acid
  misc_feature (86)..(86): Xaa can be any naturally occurring amino acid
  misc_feature (89)..(89): Xaa can be any naturally occurring amino acid
  MISC_FEATURE (90)..(90): Xaa = I or L
  misc_feature (101)..(101): Xaa can be any naturally occurring amino acid
  misc_feature (104)..(104): Xaa can be any naturally occurring amino acid
  misc_feature (111)..(111): Xaa can be any naturally occurring amino acid
  misc_feature (116)..(116): Xaa can be any naturally occurring amino acid
  misc_feature (121)..(121): Xaa can be any naturally occurring amino acid
  misc_feature (128)..(130): Xaa can be any naturally occurring amino acid
  misc_feature (133)..(133): Xaa can be any naturally occurring amino acid
  misc_feature (145)..(145): Xaa can be any naturally occurring amino acid
  misc_feature (148)..(148): Xaa can be any naturally occurring amino acid
  misc_feature (167)..(167): Xaa can be any naturally occurring amino acid
  misc_feature (174)..(174): Xaa can be any naturally occurring amino acid
  misc_feature (192)..(192): Xaa can be any naturally occurring amino acid
  misc_feature (194)..(195): Xaa can be any naturally occurring amino acid
  misc_feature (199)..(199): Xaa can be any naturally occurring amino acid
  misc_feature (202)..(203): Xaa can be any naturally occurring amino acid
  misc_feature (206)..(206): Xaa can be any naturally occurring amino acid
  misc_feature (217)..(219): Xaa can be any naturally occurring amino acid
  misc_feature (228)..(228): Xaa can be any naturally occurring amino acid
  misc_feature (233)..(233): Xaa can be any naturally occurring amino acid
  MISC_FEATURE (236)..(236): Xaa = I or L
  misc_feature (243)..(243): Xaa can be any naturally occurring amino acid
  misc_feature (245)..(245): Xaa can be any naturally occurring amino acid
  misc_feature (262)..(262): Xaa can be any naturally occurring amino acid
  MISC_FEATURE (267)..(267): Xaa = I or L
  misc_feature (277)..(278): Xaa can be any naturally occurring amino acid
  misc_feature (282)..(282): Xaa can be any naturally occurring amino acid
  misc_feature (287)..(287): Xaa can be any naturally occurring amino acid
  misc_feature (307)..(307): Xaa can be any naturally occurring amino acid
  misc_feature (314)..(314): Xaa can be any naturally occurring amino acid
  misc_feature (320)..(321): Xaa can be any naturally occurring amino acid
  misc_feature (333)..(333): Xaa can be any naturally occurring amino acid
  misc_feature (343)..(343): Xaa can be any naturally occurring amino acid
  misc_feature (357)..(357): Xaa can be any naturally occurring amino acid
  misc_feature (367)..(367): Xaa can be any naturally occurring amino acid
  misc_feature (371)..(371): Xaa can be any naturally occurring amino acid
  misc_feature (374)..(375): Xaa can be any naturally occurring amino acid
  misc_feature (378)..(378): Xaa can be any naturally occurring amino acid
  misc_feature (392)..(392): Xaa can be any naturally occurring amino acid
  misc_feature (402)..(402): Xaa can be any naturally occurring amino acid
  misc_feature (414)..(415): Xaa can be any naturally occurring amino acid
  MISC_FEATURE (418)..(418): Xaa = I or L
  misc_feature (446)..(446): Xaa can be any naturally occurring amino acid
  misc_feature (448)..(449): Xaa can be any naturally occurring amino acid
  misc_feature (451)..(451): Xaa can be any naturally occurring amino acid
  misc_feature (467)..(467): Xaa can be any naturally occurring amino acid
  misc_feature (489)..(489): Xaa can be any naturally occurring amino acid
  misc_feature (500)..(500): Xaa can be any naturally occurring amino acid
  misc_feature (510)..(510): Xaa can be any naturally occurring amino acid
  misc_feature (514)..(514): Xaa can be any naturally occurring amino acid
  misc_feature (528)..(529): Xaa can be any naturally occurring amino acid
  misc_feature (532)..(532): Xaa can be any naturally occurring amino acid
  misc_feature (539)..(539): Xaa can be any naturally occurring amino acid
  misc_feature (547)..(548): Xaa can be any naturally occurring amino acid
  misc_feature (551)..(551): Xaa can be any naturally occurring amino acid
  misc_feature (553)..(554): Xaa can be any naturally occurring amino acid
  misc_feature (565)..(565): Xaa can be any naturally occurring amino acid
  misc_feature (576)..(576): Xaa can be any naturally occurring amino acid
  misc_feature (587)..(588): Xaa can be any naturally occurring amino acid
  misc_feature (600)..(600): Xaa can be any naturally occurring amino acid
  misc_feature (604)..(605): Xaa can be any naturally occurring amino acid
  misc_feature (622)..(622): Xaa can be any naturally occurring amino acid
  misc_feature (627)..(627): Xaa can be any naturally occurring amino acid
  misc_feature (629)..(629): Xaa can be any naturally occurring amino acid
  misc_feature (655)..(655): Xaa can be any naturally occurring amino acid
  misc_feature (662)..(662): Xaa can be any naturally occurring amino acid
  misc_feature (682)..(682): Xaa can be any naturally occurring amino acid
  misc_feature (686)..(686): Xaa can be any naturally occurring amino acid
  MISC_FEATURE (688)..(688): Xaa = I or L
  misc_feature (691)..(691): Xaa can be any naturally occurring amino acid
  misc_feature (698)..(698): Xaa can be any naturally occurring amino acid
  misc_feature (706)..(706): Xaa can be any naturally occurring amino acid
  misc_feature (723)..(723): Xaa can be any naturally occurring amino acid
  MISC_FEATURE (737)..(737): Xaa = I or L
  misc_feature (738)..(738): Xaa can be any naturally occurring amino acid
  misc_feature (760)..(761): Xaa can be any naturally occurring amino acid
  misc_feature (771)..(771): Xaa can be any naturally occurring amino acid
  misc_feature (773)..(773): Xaa can be any naturally occurring amino acid
  misc_feature (779)..(779): Xaa can be any naturally occurring amino acid
  misc_feature (786)..(786): Xaa can be any naturally occurring amino acid
  misc_feature (790)..(790): Xaa can be any naturally occurring amino acid
  misc_feature (798)..(798): Xaa can be any naturally occurring amino acid
  misc_feature (800)..(800): Xaa can be any naturally occurring amino acid
  misc_feature (834)..(834): Xaa can be any naturally occurring amino acid
  misc_feature (843)..(843): Xaa can be any naturally occurring amino acid
  misc_feature (851)..(852): Xaa can be any naturally occurring amino acid
  misc_feature (866)..(866): Xaa can be any naturally occurring amino acid
  misc_feature (870)..(870): Xaa can be any naturally occurring amino acid
  misc_feature (873)..(873): Xaa can be any naturally occurring amino acid
  misc_feature (877)..(877): Xaa can be any naturally occurring amino acid
  misc_feature (889)..(889): Xaa can be any naturally occurring amino acid
  misc_feature (896)..(896): Xaa can be any naturally occurring amino acid
  misc_feature (916)..(916): Xaa can be any naturally occurring amino acid
  misc_feature (923)..(923): Xaa can be any naturally occurring amino acid
  misc_feature (936)..(936): Xaa can be any naturally occurring amino acid
  misc_feature (962)..(962): Xaa can be any naturally occurring amino acid
  misc_feature (966)..(966): Xaa can be any naturally occurring amino acid
  misc_feature (970)..(970): Xaa can be any naturally occurring amino acid
  misc_feature (985)..(985): Xaa can be any naturally occurring amino acid
  misc_feature (996)..(996): Xaa can be any naturally occurring amino acid
MKISKVXXXVXKKXXXGKLXKXVNERNRXAKRLSNXLBKYIXXIDKIXKKEXXKKFXAXEEITLKLNQXXXBXLXKAXXDLRKDNXYSXXKKILHNEDINXEEXELLINDXLEKLXKIESXKYSYQKXXXNYXMSVQEHSKKSIXRIXESAKRNKEALDKFLKEYAXLDPRMEXLAKLRKLLELYFYFKNDXIXXEEEXNVXXHKXLKENHPDFVEXXXNKENAELNXYAIEXKKXLKYYFPXKXAKNSNDKIFEKQELKKXWIHQXENAVERILLXXGKVXYKLQXGYLAELWKIRINEIFIKYIXVGKAVAXFALRNXXKBENDILGGKIXKKLNGITSFXYEKIKAEEILQREXAVEVAFAANXLYAXDLXXIRXSILQFFGGASNWDXFLFFHFATSXISDKKWNAELIXXKKXGLVIREKLYSNNVAMFYSKDDLEKLLNXLXXFXLRASQVPSFKKVYVRXBFPQNLLKKFNDEKDDEAYSAXYYLLKEIYYNXFLPYFSANNXFFFXVKNLVLKANKDKFXXAFXDIREMNXGSPIEYLXXTQXNXXNEGRKKEEKEXDFIKFLLQIFXKGFDDYLKNNXXFILKFIPEPTEXIEIXXELQAWYIVGKFLNARKXNLLGXFXSYLKLLDDIELRALRNENIKYQSSNXEKEVLEXCLELIGLLSLDLNDYFBDEXDFAXYXGKXLDFEKKXMKDLAELXPYDQNDGENPIVNRNIXLAKKYGTLNLLEKXXDKVSEKEIKEYYELKKEIEEYXXKGEELHEEWXQXKNRVEXRDILEYXEELXGQIINYNXLXNKVLLYFQLGLHYLLLDILGRLVGYTGIWERDAXLYQIAAMYXNGLPEYIXXKKNDKYKDGQIVGXKINXFKXDKKXLYNAGLELFENXNEHKNIXIRNYIAHFNYLSKAESSLLXYSENLRXLFSYDRKLKNAVXKSLINILLRHGMVLKFKFGTDKKSVXIRSXKKIXHLKSIAKKLYYPEVXVSKEYCKLVKXLLKYK

SEQ ID NO: 370 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 371 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 372 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 373 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 374 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 375 - protein, 953 aa, Alistipes species
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 376 - protein, 1322 aa, Prevotella species
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 377 - protein, 1322 aa, Prevotella species; identical to SEQ ID NO: 376

SEQ ID NO: 378 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 379 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 380 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 381 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 382 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 383 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 384 - protein, 1090 aa, Prevotella species
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 385 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 386 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 387 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 388 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 389 - protein, 1175 aa, Porphyromonas species
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 390 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 391 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 392 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 393 - protein, 1127 aa, Prevotella buccae; identical to SEQ ID NO: 372

SEQ ID NO: 394 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 395 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 396 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 397 - protein, 1161 aa, Bacteroidetes bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 398 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 399 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 400 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 401 - protein, 953 aa, Unknown; identical to SEQ ID NO: 375
  Cas13b orthologue

SEQ ID NO: 402 - protein, 1036 aa, Chryseobacterium ureilyticum; identical to SEQ ID NO: 400

SEQ ID NO: 403 - protein, 1090 aa, Unknown; identical to SEQ ID NO: 384
  Cas13b orthologue

SEQ ID NO: 404 - protein, 1095 aa, Unknown; identical to SEQ ID NO: 378
  Cas13b orthologue

SEQ ID NO: 405 - protein, 1115 aa, Unknown; identical to SEQ ID NO: 374
  Cas13b orthologue

SEQ ID NO: 406 - protein, 1119 aa, Unknown; identical to SEQ ID NO: 388
  Cas13b orthologue

SEQ ID NO: 407 - protein, 1120 aa, Unknown; identical to SEQ ID NO: 382
  Cas13b orthologue

SEQ ID NO: 408 - protein, 1124 aa, Unknown; identical to SEQ ID NO: 379
  Cas13b orthologue

SEQ ID NO: 409 - protein, 1125 aa, Prevotella pallens; identical to SEQ ID NO: 394

SEQ ID NO: 410 - protein, 1125 aa, Homo sapiens
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 411 - protein, 1126 aa, Unknown; identical to SEQ ID NO: 371
  Cas13b orthologue

SEQ ID NO: 412 - protein, 1127 aa, Unknown; identical to SEQ ID NO: 372
  Cas13b orthologue

SEQ ID NO: 413 - protein, 1132 aa, Unknown; identical to SEQ ID NO: 390
  Cas13b orthologue

SEQ ID NO: 414 - protein, 1133 aa, Prevotella intermedia; identical to SEQ ID NO: 392

SEQ ID NO: 415 - protein, 1135 aa, Unknown; identical to SEQ ID NO: 373
  Cas13b orthologue

SEQ ID NO: 416 - protein, 1150 aa, Unknown; identical to SEQ ID NO: 385
  Cas13b orthologue

SEQ ID NO: 417 - protein, 1151 aa, Unknown; identical to SEQ ID NO: 380
  Cas13b orthologue

SEQ ID NO: 418 - protein, 1156 aa, Chryseobacterium carnipullorum; identical to SEQ ID NO: 399

SEQ ID NO: 419 - protein, 1159 aa, Unknown; identical to SEQ ID NO: 381
  Cas13b orthologue

SEQ ID NO: 420 - protein, 1159 aa, Unknown; identical to SEQ ID NO: 386
  Cas13b orthologue

SEQ ID NO: 421 - protein, 1161 aa, Bacteroidetes bacterium; identical to SEQ ID NO: 397

SEQ ID NO: 422 - protein, 1165 aa, Chryseobacterium jejuense; identical to SEQ ID NO: 398

SEQ ID NO: 423 - protein, 1175 aa, Unknown
  Cas13b orthologue
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 424 - protein, 1175 aa, Unknown; identical to SEQ ID NO: 389
  Cas13b orthologue

SEQ ID NO: 425 - protein, 1199 aa, Unknown; identical to SEQ ID NO: 383
  Cas13b orthologue

SEQ ID NO: 426 - protein, 1214 aa, Unknown; identical to SEQ ID NO: 387
  Cas13b orthologue

SEQ ID NO: 427 - protein, 1224 aa, Unknown; identical to SEQ ID NO: 370
  Cas13b orthologue

SEQ ID NO: 428 - protein, 1322 aa, Unknown; identical to SEQ ID NO: 376
  Cas13b orthologue

SEQ ID NO: 429 - protein, 1322 aa, Unknown; identical to SEQ ID NO: 376
  Cas13b orthologue

SEQ ID NO: 430 - protein, 10 aa, Artificial Sequence
  Synthetic Peptide
  MISC_FEATURE (3)..(3): Xaa = any amino acid
  MISC_FEATURE (6)..(8): Xaa = any amino acid
DNXSTXXXRK

SEQ ID NO: 431 - DNA, 10 bp, Artificial Sequence
  Synthetic Oligonucleotide
tatatatata

SEQ ID NO: 432 - DNA, 15 bp, Artificial Sequence
  Synthetic Oligonucleotide
gtcgtcgtcgtcgtc

SEQ ID NO: 433 - DNA, 64 bp, Artificial Sequence
  Synthetic Oligonucleotide
gatttagactaccccaaaaacgaaggggactaaaacgtaggtgatcggcgtcggcgtcttcggc

SEQ ID NO: 434 - DNA, 28 bp, Artificial Sequence
  Synthetic Oligonucleotide
gtaggtgatcggcgtcggcgtcttcggc

SEQ ID NO: 435 - DNA, 36 bp, Artificial Sequence
  Synthetic Oligonucleotide
gatttagactaccccaaaaacgaaggggactaaaac

SEQ ID NO: 436 - DNA, 64 bp, Artificial Sequence
  Synthetic Oligonucleotide
gatttagactaccccaaaaacgaaggggactaaaacggggtggagtagagggcgcgaccaagag

SEQ ID NO: 437 - DNA, 28 bp, Artificial Sequence
  Synthetic Oligonucleotide
ggggtggagtagagggcgcgaccaagag

SEQ ID NO: 438 - DNA, 36 bp, Artificial Sequence; identical to SEQ ID NO: 435
  Synthetic Oligonucleotide

SEQ ID NO: 439 - DNA, 66 bp, Artificial Sequence
  Synthetic Oligonucleotide
tgggggtggagtagagggcgcgaccaagaggttgtagaagcttatcgtttggataggtatgacaac

SEQ ID NO: 440 - DNA, 30 bp, Artificial Sequence
  Synthetic Oligonucleotide
tgggggtggagtagagggcgcgaccaagag

SEQ ID NO: 441 - DNA, 36 bp, Artificial Sequence
  Synthetic Oligonucleotide
gttgtagaagcttatcgtttggataggtatgacaac

SEQ ID NO: 442 - DNA, 23 bp, Artificial Sequence
  Synthetic Oligonucleotide
gtgaccgtcttcccgttaccttg

SEQ ID NO: 443 - DNA, 48 bp, Artificial Sequence
  Synthetic Oligonucleotide
gaaattaatacgactcactataggggtgaccgtcttcccgttaccttg

SEQ ID NO: 444 - DNA, 21 bp, Artificial Sequence
  Synthetic Oligonucleotide
ctcgatgaccgtcgtgatgcc

SEQ ID NO: 445 - DNA, 25 bp, Artificial Sequence
  Synthetic Oligonucleotide
tcaataaggttgacgaaaacggcac

SEQ ID NO: 446 - DNA, 50 bp, Artificial Sequence
  Synthetic Oligonucleotide
gaaattaatacgactcactatagggtcaataaggttgacgaaaacggcac

SEQ ID NO: 447 - DNA, 25 bp, Artificial Sequence
  Synthetic Oligonucleotide
tagaaggtgaagttgaaggaagcgg

SEQ ID NO: 448 - RNA, 5 nt, Artificial Sequence
  Synthetic Oligonucleotide
  misc_feature (1)..(1): 5' FAM tag
  misc_feature (5)..(5): 3' 3IABkFQ tag
uuuuu

SEQ ID NO: 449 - RNA, 5 nt, Artificial Sequence
  Synthetic Oligonucleotide
  misc_feature (1)..(1): 5' FAM tag
  misc_feature (5)..(5): 3' 3IABkFQ tag
aaaaa

SEQ ID NO: 450 - RNA, 5 nt, Artificial Sequence
  Synthetic Oligonucleotide
  misc_feature (1)..(1): 5' HEX tag
  misc_feature (5)..(5): 3' 3IABkFQ tag
uuuuu

SEQ ID NO: 451 - RNA, 14 nt, Artificial Sequence
  Synthetic Oligonucleotide
  misc_feature (1)..(1): 5' FAM tag
  misc_feature (1)..(1): modified nucleotide
  misc_feature (7)..(8): modified nucleotide
  misc_feature (14)..(14): modified nucleotide
  misc_feature (14)..(14): 3' biotin tag
aauggcaaauggca

SEQ ID NO: 452 - RNA, 11 nt, Artificial Sequence
  Synthetic Oligonucleotide
aaaaaauuuuu

SEQ ID NO: 453 - DNA, 66 bp, Artificial Sequence
  Synthetic Oligonucleotide
gatttagactaccccaaaaacgaaggggactaaaacctaccaagtaatccatatttctagaggatc

SEQ ID NO: 454 - DNA, 30 bp, Artificial Sequence
  Synthetic Oligonucleotide
ctaccaagtaatccatatttctagaggatc

SEQ ID NO: 455 - DNA, 36 bp, Artificial Sequence; identical to SEQ ID NO: 435
  Synthetic Oligonucleotide

SEQ ID NO: 456 - DNA, 66 bp, Bergeyella zoohelcum
ctaccaagtaatccatatttctagaggatcgttggaactgctctcattttggagggtaatcacaac

SEQ ID NO: 457 - DNA, 30 bp, Bergeyella zoohelcum; identical to SEQ ID NO: 454

SEQ ID NO: 458 - DNA, 36 bp, Bergeyella zoohelcum
gttggaactgctctcattttggagggtaatcacaac

SEQ ID NO: 459 - DNA, 66 bp, Prevotella intermedia
ctaccaagtaatccatatttctagaggatcgttgcatctgcctgctgtttgcaaggtaaaaacaac

SEQ ID NO: 460 - DNA, 30 bp, Prevotella intermedia; identical to SEQ ID NO: 454

SEQ ID NO: 461 - DNA, 36 bp, Prevotella intermedia
gttgcatctgcctgctgtttgcaaggtaaaaacaac

SEQ ID NO: 462 - DNA, 66 bp, Prevotella buccae
ctaccaagtaatccatatttctagaggatcgttgcatctgccttctttttgaaaggtaaaaacaac

SEQ ID NO: 463 - DNA, 30 bp, Prevotella buccae; identical to SEQ ID NO: 454

SEQ ID NO: 464 - DNA, 36 bp, Prevotella buccae
gttgcatctgccttctttttgaaaggtaaaaacaac

SEQ ID NO: 465 - DNA, 66 bp, Alistipes species
ctaccaagtaatccatatttctagaggatcgctgttatatccttacctttgtaagggaagtacagc

SEQ ID NO: 466 - DNA, 30 bp, Alistipes species; identical to SEQ ID NO: 454

SEQ ID NO: 467 - DNA, 36 bp, Alistipes species
gctgttatatccttacctttgtaagggaagtacagc

SEQ ID NO: 468 - DNA, 66 bp, Prevotella species
ctaccaagtaatccatatttctagaggatcgttgtagaagcttatcgtttggataggtatgacaac

SEQ ID NO: 469 - DNA, 30 bp, Prevotella species; identical to SEQ ID NO: 454

SEQ ID NO: 470 - DNA, 36 bp, Prevotella species; identical to SEQ ID NO: 441

SEQ ID NO: 471 - DNA, 66 bp, Riemerella anatipestifer
ctaccaagtaatccatatttctagaggatcgttgggactgctctcactttgaagggtattcacaac

SEQ ID NO: 472 - DNA, 30 bp, Riemerella anatipestifer; identical to SEQ ID NO: 454

SEQ ID NO: 473 - DNA, 36 bp, Riemerella anatipestifer
gttgggactgctctcactttgaagggtattcacaac

SEQ ID NO: 474 - DNA, 66 bp, Prevotella aurantiaca
ctaccaagtaatccatatttctagaggatcgttgtatctgccttctgtttgaaaggtaaaaacaac

SEQ ID NO: 475 - DNA, 30 bp, Prevotella aurantiaca; identical to SEQ ID NO: 454

SEQ ID NO: 476 - DNA, 36 bp, Prevotella aurantiaca
gttgtatctgccttctgtttgaaaggtaaaaacaac

SEQ ID NO: 477 - DNA, 66 bp, Prevotella saccharolytica
ctaccaagtaatccatatttctagaggatcgttgtgtctacctcctttttgagaggtaaaaacagc

SEQ ID NO: 478 - DNA, 30 bp, Prevotella saccharolytica; identical to SEQ ID NO: 454

SEQ ID NO: 479 - DNA, 36 bp, Prevotella saccharolytica
gttgtgtctacctcctttttgagaggtaaaaacagc

SEQ ID NO: 480 - DNA, 66 bp, Prevotella intermedia; identical to SEQ ID NO: 459

SEQ ID NO: 481 - DNA, 30 bp, Prevotella intermedia; identical to SEQ ID NO: 454

SEQ ID NO: 482 - DNA, 36 bp, Prevotella intermedia; identical to SEQ ID NO: 461

SEQ ID NO: 483 - DNA, 66 bp, Capnocytophaga canimorsus; identical to SEQ ID NO: 456

SEQ ID NO: 484 - DNA, 30 bp, Capnocytophaga canimorsus; identical to SEQ ID NO: 454

SEQ ID NO: 485 - DNA, 36 bp, Capnocytophaga canimorsus; identical to SEQ ID NO: 458

SEQ ID NO: 486 - DNA, 66 bp, Porphyromonas gulae
ctaccaagtaatccatatttctagaggatcgttggatctaccctctatttgaagggtacacacaac

SEQ ID NO: 487 - DNA, 30 bp, Porphyromonas gulae; identical to SEQ ID NO: 454

SEQ ID NO: 488 - DNA, 36 bp, Porphyromonas gulae
gttggatctaccctctatttgaagggtacacacaac

SEQ ID NO: 489 - DNA, 66 bp, Prevotella species
ctaccaagtaatccatatttctagaggatcgttgtggaaggtccagttttgaggggctattacaac

SEQ ID NO: 490 - DNA, 30 bp, Prevotella species; identical to SEQ ID NO: 454

SEQ ID NO: 491 - DNA, 36 bp, Prevotella species
gttgtggaaggtccagttttgaggggctattacaac

SEQ ID NO: 492 - DNA, 66 bp, Porphyromonas gingivalis
ctaccaagtaatccatatttctagaggatcgttggatctaccctctattcgaagggtacacacaac

SEQ ID NO: 493 - DNA, 30 bp, Porphyromonas gingivalis; identical to SEQ ID NO: 454

SEQ ID NO: 494 - DNA, 36 bp, Porphyromonas gingivalis
gttggatctaccctctattcgaagggtacacacaac

SEQ ID NO: 495 - DNA, 51 bp, Prevotella intermedia
ctaccaagtaatccatatttctagaggatcgttgcatctgcctgctgtttg

SEQ ID NO: 496 - DNA, 30 bp, Prevotella intermedia; identical to SEQ ID NO: 454

SEQ ID NO: 497 - DNA, 36 bp, Prevotella intermedia; identical to SEQ ID NO: 461

SEQ ID NO: 498 - DNA, 64 bp, Dengue virus
gatttagactaccccaaaaacgaaggggactaaaactgcttctgtccagtgagcatggtcttcg

SEQ ID NO: 499 - DNA, 28 bp, Dengue virus
tgcttctgtccagtgagcatggtcttcg

SEQ ID NO: 500 - DNA, 36 bp, Dengue virus; identical to SEQ ID NO: 435

SEQ ID NO: 501 - DNA, 66 bp, Dengue virus
tttgcttctgtccagtgagcatggtcttcggttgtagaagcttatcgtttggataggtatgacaac

SEQ ID NO: 502 - DNA, 30 bp, Dengue virus
tttgcttctgtccagtgagcatggtcttcg

SEQ ID NO: 503 - DNA, 36 bp, Dengue virus; identical to SEQ ID NO: 441

SEQ ID NO: 504 - DNA, 40 bp, Artificial Sequence
  Synthetic Oligonucleotide
taatttctactcttgtagatctgtgtttatccgctcacaa

SEQ ID NO: 505 - DNA, 20 bp, Artificial Sequence
  Synthetic Oligonucleotide
ctgtgtttatccgctcacaa

SEQ ID NO: 506 - DNA, 20 bp, Artificial Sequence
  Synthetic Oligonucleotide
taatttctactcttgtagat

SEQ ID NO: 507 - DNA, 66 bp, Prevotella species
atgctttgtttcaggtgtatcaaccaataagttgtagaagcttatcgtttggataggtatgacaac

SEQ ID NO: 508 - DNA, 30 bp, Prevotella species
atgctttgtttcaggtgtatcaaccaataa

SEQ ID NO: 509 - DNA, 36 bp, Prevotella species; identical to SEQ ID NO: 441

SEQ ID NO: 510 - DNA, 64 bp, Leptotrichia wadei
gatttagactaccccaaaaacgaaggggactaaaacagcacgctcacccgcgggttgccttcgg

SEQ ID NO: 511 - DNA, 28 bp, Leptotrichia wadei
agcacgctcacccgcgggttgccttcgg

SEQ ID NO: 512 - DNA, 36 bp, Leptotrichia wadei; identical to SEQ ID NO: 435

SEQ ID NO: 513 - DNA, 64 bp, Zika virus
gatttagactaccccaaaaacgaaggggactaaaacactccctagaaccacgacagtttgcctt

SEQ ID NO: 514 - DNA, 28 bp, Zika virus
actccctagaaccacgacagtttgcctt

SEQ ID NO: 515 - DNA, 36 bp, Zika virus; identical to SEQ ID NO: 435

SEQ ID NO: 516 - DNA, 64 bp, Homo sapiens
gatttagactaccccaaaaacgaaggggactaaaacccaggccaaaatctgtgatcttgacatg

SEQ ID NO: 517 - DNA, 28 bp, Homo sapiens
ccaggccaaaatctgtgatcttgacatg

SEQ ID NO: 518 - DNA, 36 bp, Homo sapiens; identical to SEQ ID NO: 435

SEQ ID NO: 519 - DNA, 64 bp, Homo sapiens
gatttagactaccccaaaaacgaaggggactaaaaccccggccaaaatctgtgatcttgacatg

SEQ ID NO: 520 - DNA, 28 bp, Homo sapiens
cccggccaaaatctgtgatcttgacatg

SEQ ID NO: 521 - DNA, 36 bp, Homo sapiens; identical to SEQ ID NO: 435

SEQ ID NO: 522 - DNA, 64 bp, Homo sapiens
gatttagactaccccaaaaacgaaggggactaaaacgttggctttcggagatgtcttgatagcg

SEQ ID NO: 523 - DNA, 28 bp, Homo sapiens
gttggctttcggagatgtcttgatagcg

SEQ ID NO: 524 - DNA, 36 bp, Homo sapiens; identical to SEQ ID NO: 435

SEQ ID NO: 525 - DNA, 64 bp, Homo sapiens
gatttagactaccccaaaaacgaaggggactaaaacgatgttgcttctcttaattccttgatag

SEQ ID NO: 526 - DNA, 28 bp, Homo sapiens
gatgttgcttctcttaattccttgatag

SEQ ID NO: 527 - DNA, 36 bp, Homo sapiens; identical to SEQ ID NO: 435

SEQ ID NO: 528 - DNA, 64 bp, Homo sapiens
gatttagactaccccaaaaacgaaggggactaaaaccctatcaggtttcacagtaagcgcgtat

SEQ ID NO: 529 - DNA, 28 bp, Homo sapiens
cctatcaggtttcacagtaagcgcgtat

SEQ ID NO: 530 - DNA, 36 bp, Homo sapiens; identical to SEQ ID NO: 435

SEQ ID NO: 531 - DNA, 66 bp, Homo sapiens
cctggttcatgagcttcctgccactgccaagttgtagaagcttatcgtttggataggtatgacaac

SEQ ID NO: 532 - DNA, 30 bp, Homo sapiens
cctggttcatgagcttcctgccactgccaa

SEQ ID NO: 533 - DNA, 36 bp, Homo sapiens; identical to SEQ ID NO: 441

SEQ ID NO: 534 - DNA, 63 bp, Dengue virus
gttgatgagaagagcccaagatagagggcaataactgcttctgtccagtgagcatggtcttcg

SEQ ID NO: 535 - DNA, 28 bp, Dengue virus
tgcttctgtccagtgagcatggtcttcg

SEQ ID NO: 536 - DNA, 35 bp, Dengue virus
gttgatgagaagagcccaagatagagggcaataac

SEQ ID NO: 537 - DNA, 66 bp, Zika virus
tgactccctagaaccacgacagtttgccttgttgtagaagcttatcgtttggataggtatgacaac

SEQ ID NO: 538 - DNA, 30 bp, Zika virus
tgactccctagaaccacgacagtttgcctt

SEQ ID NO: 539 - DNA, 36 bp, Zika virus; identical to SEQ ID NO: 441

SEQ ID NO: 540 - DNA, 63 bp, Zika virus
gttgatgagaagagcccaagatagagggcaataacactccctagaaccacgacagtttgcctt

SEQ ID NO: 541 - DNA, 28 bp, Zika virus
actccctagaaccacgacagtttgcctt

SEQ ID NO: 542 - DNA, 35 bp, Zika virus; identical to SEQ ID NO: 536

SEQ ID NO: 543 - DNA, 59 bp, Dengue virus
gaccaccccaaaaatgaaggggactaaaacatgcttctgtccagtgagcatggtcttcg

SEQ ID NO: 544 - DNA, 28 bp, Dengue virus
tgcttctgtccagtgagcatggtcttcg

SEQ ID NO: 545 - DNA, 31 bp, Dengue virus
gaccaccccaaaaatgaaggggactaaaaca

SEQ ID NO: 546 - DNA, 59 bp, Zika virus
gaccaccccaaaaatgaaggggactaaaacaactccctagaaccacgacagtttgcctt

SEQ ID NO: 547 - DNA, 28 bp, Zika virus
actccctagaaccacgacagtttgcctt

SEQ ID NO: 548 - DNA, 31 bp, Zika virus; identical to SEQ ID NO: 545

SEQ ID NO: 549 - DNA, 57 bp, Dengue virus
gaccaccccaaaaatgaaggggactaaaacatgcttctgtccagtgagcatggtctt

SEQ ID NO: 550 - DNA, 26 bp, Dengue virus
tgcttctgtccagtgagcatggtctt

SEQ ID NO: 551 - DNA, 31 bp, Dengue virus; identical to SEQ ID NO: 545

SEQ ID NO: 552 - DNA, 55 bp, Dengue virus
gaccaccccaaaaatgaaggggactaaaacatgcttctgtccagtgagcatggtc

SEQ ID NO: 553 - DNA, 24 bp, Dengue virus
tgcttctgtccagtgagcatggtc

SEQ ID NO: 554 - DNA, 31 bp, Dengue virus; identical to SEQ ID NO: 545

SEQ ID NO: 555 - DNA, 53 bp, Dengue virus
gaccaccccaaaaatgaaggggactaaaacatgcttctgtccagtgagcatgg

SEQ ID NO: 556 - DNA, 22 bp, Dengue virus
tgcttctgtccagtgagcatgg

SEQ ID NO: 557 - DNA, 31 bp, Dengue virus; identical to SEQ ID NO: 545

SEQ ID NO: 558 - DNA, 51 bp, Dengue virus
gaccaccccaaaaatgaaggggactaaaacatgcttctgtccagtgagcat

SEQ ID NO: 559 - DNA, 20 bp, Dengue virus
tgcttctgtccagtgagcat

SEQ ID NO: 560 - DNA, 31 bp, Dengue virus; identical to SEQ ID NO: 545

SEQ ID NO: 561 - DNA, 49 bp, Dengue virus
gaccaccccaaaaatgaaggggactaaaacatgcttctgtccagtgagc

SEQ ID NO: 562 - DNA, 18 bp, Dengue virus
tgcttctgtccagtgagc

SEQ ID NO: 563 - DNA, 31 bp, Dengue virus; identical to SEQ ID NO: 545

SEQ ID NO: 564 - DNA, 70 bp, Capnocytophaga canimorsus
tgttctaccaagtaatccatatttctagaggatcgttggaactgctctcattttggagggtaatcacaac

SEQ ID NO: 565 - DNA, 34 bp, Capnocytophaga canimorsus
tgttctaccaagtaatccatatttctagaggatc

SEQ ID NO: 566 - DNA, 36 bp, Capnocytophaga canimorsus; identical to SEQ ID NO: 458

SEQ ID NO: 567 - DNA, 69 bp, Capnocytophaga canimorsus
gttctaccaagtaatccatatttctagaggatcgttggaactgctctcattttggagggtaatcacaac

SEQ ID NO: 568 - DNA, 33 bp, Capnocytophaga canimorsus
gttctaccaagtaatccatatttctagaggatc

SEQ ID NO: 569 - DNA, 36 bp, Capnocytophaga canimorsus; identical to SEQ ID NO: 458

SEQ ID NO: 570 - DNA, 68 bp, Capnocytophaga canimorsus
ttctaccaagtaatccatatttctagaggatcgttggaactgctctcattttggagggtaatcacaac

SEQ ID NO: 571 - DNA, 32 bp, Capnocytophaga canimorsus
ttctaccaagtaatccatatttctagaggatc

SEQ ID NO: 572 - DNA, 36 bp, Capnocytophaga canimorsus; identical to SEQ ID NO: 458

SEQ ID NO: 573 - DNA, 67 bp, Capnocytophaga canimorsus
tctaccaagtaatccatatttctagaggatcgttggaactgctctcattttggagggtaatcacaac

SEQ ID NO: 574 - DNA, 31 bp, Capnocytophaga canimorsus
tctaccaagtaatccatatttctagaggatc

SEQ ID NO: 575 - DNA, 36 bp, Capnocytophaga canimorsus; identical to SEQ ID NO: 458

SEQ ID NO: 576 - DNA, 66 bp, Capnocytophaga canimorsus; identical to SEQ ID NO: 456

SEQ ID NO: 577 - DNA, 30 bp, Capnocytophaga canimorsus; identical to SEQ ID NO: 454

SEQ ID NO: 578 - DNA, 36 bp, Capnocytophaga canimorsus; identical to SEQ ID NO: 458

SEQ ID NO: 579 - DNA, 65 bp, Capnocytophaga canimorsus
taccaagtaatccatatttctagaggatcgttggaactgctctcattttggagggtaatcacaac

SEQ ID NO: 580 - DNA, 29 bp, Capnocytophaga canimorsus
taccaagtaatccatatttctagaggatc

SEQ ID NO: 581 - DNA, 36 bp, Capnocytophaga canimorsus; identical to SEQ ID NO: 458

SEQ ID NO: 582 - DNA, 64 bp, Capnocytophaga canimorsus
accaagtaatccatatttctagaggatcgttggaactgctctcattttggagggtaatcacaac

SEQ ID NO: 583 - DNA, 28 bp, Capnocytophaga canimorsus
accaagtaatccatatttctagaggatc

SEQ ID NO: 584 - DNA, 36 bp, Capnocytophaga canimorsus; identical to SEQ ID NO: 458

SEQ ID NO: 585 - DNA, 63 bp, Capnocytophaga canimorsus
ccaagtaatccatatttctagaggatcgttggaactgctctcattttggagggtaatcacaac

SEQ ID NO: 586 - DNA, 27 bp, Capnocytophaga canimorsus
ccaagtaatccatatttctagaggatc

SEQ ID NO: 587 - DNA, 36 bp, Capnocytophaga canimorsus; identical to SEQ ID NO: 458

SEQ ID NO: 588 - DNA, 62 bp, Capnocytophaga canimorsus
caagtaatccatatttctagaggatcgttggaactgctctcattttggagggtaatcacaac

SEQ ID NO: 589 - DNA, 26 bp, Capnocytophaga canimorsus
caagtaatccatatttctagaggatc

SEQ ID NO: 590 - DNA, 36 bp, Capnocytophaga canimorsus; identical to SEQ ID NO: 458

SEQ ID NO: 591 - DNA, 61 bp, Capnocytophaga canimorsus
aagtaatccatatttctagaggatcgttggaactgctctcattttggagggtaatcacaac

SEQ ID NO: 592 - DNA, 25 bp, Capnocytophaga canimorsus
aagtaatccatatttctagaggatc

SEQ ID NO: 593 - DNA, 36 bp, Capnocytophaga canimorsus; identical to SEQ ID NO: 458

SEQ ID NO: 594 - DNA, 60 bp, Capnocytophaga canimorsus
agtaatccatatttctagaggatcgttggaactgctctcattttggagggtaatcacaac

SEQ ID NO: 595 - DNA, 24 bp, Capnocytophaga canimorsus
agtaatccatatttctagaggatc

SEQ ID NO: 596 - DNA, 36 bp, Capnocytophaga canimorsus; identical to SEQ ID NO: 458

SEQ ID NO: 597 - DNA, 59 bp, Capnocytophaga canimorsus
gtaatccatatttctagaggatcgttggaactgctctcattttggagggtaatcacaac

SEQ ID NO: 598 - DNA, 23 bp, Capnocytophaga canimorsus
gtaatccatatttctagaggatc

SEQ ID NO: 599 - DNA, 36 bp, Capnocytophaga canimorsus; identical to SEQ ID NO: 458

SEQ ID NO: 600 - DNA, 58 bp, Capnocytophaga canimorsus
taatccatatttctagaggatcgttggaactgctctcattttggagggtaatcacaac

SEQ ID NO: 601 - DNA, 22 bp, Capnocytophaga canimorsus
taatccatatttctagaggatc

SEQ ID NO: 602 - DNA, 36 bp, Capnocytophaga canimorsus; identical to SEQ ID NO: 458

SEQ ID NO: 603 - DNA, 57 bp, Capnocytophaga canimorsus
aatccatatttctagaggatcgttggaactgctctcattttggagggtaatcacaac

SEQ ID NO: 604 - DNA, 21 bp, Capnocytophaga canimorsus
aatccatatttctagaggatc

SEQ ID NO: 605 - DNA, 36 bp, Capnocytophaga canimorsus; identical to SEQ ID NO: 458

SEQ ID NO: 606 - DNA, 56 bp, Capnocytophaga canimorsus
atccatatttctagaggatcgttggaactgctctcattttggagggtaatcacaac

SEQ ID NO: 607 - DNA, 20 bp, Capnocytophaga canimorsus
atccatatttctagaggatc

SEQ ID NO: 608 - DNA, 36 bp, Capnocytophaga canimorsus; identical to SEQ ID NO: 458

SEQ ID NO: 609 - DNA, 55 bp, Capnocytophaga canimorsus
tccatatttctagaggatcgttggaactgctctcattttggagggtaatcacaac

SEQ ID NO: 610 - DNA, 19 bp, Capnocytophaga canimorsus
tccatatttctagaggatc

SEQ ID NO: 611 - DNA, 36 bp, Capnocytophaga canimorsus; identical to SEQ ID NO: 458

SEQ ID NO: 612 - DNA, 54 bp, Capnocytophaga canimorsus
ccatatttctagaggatcgttggaactgctctcattttggagggtaatcacaac

SEQ ID NO: 613 - DNA, 18 bp, Capnocytophaga canimorsus
ccatatttctagaggatc

SEQ ID NO: 614 - DNA, 36 bp, Capnocytophaga canimorsus; identical to SEQ ID NO: 458

SEQ ID NO: 615 - DNA, 53 bp, Capnocytophaga canimorsus
catatttctagaggatcgttggaactgctctcattttggagggtaatcacaac

SEQ ID NO: 616 - DNA, 17 bp, Capnocytophaga canimorsus
catatttctagaggatc

SEQ ID NO: 617 - DNA, 36 bp, Capnocytophaga canimorsus; identical to SEQ ID NO: 458

SEQ ID NO: 618 - DNA, 52 bp, Capnocytophaga canimorsus
atatttctagaggatcgttggaactgctctcattttggagggtaatcacaac

SEQ ID NO: 619 - DNA, 16 bp, Capnocytophaga canimorsus
atatttctagaggatc

SEQ ID NO: 620 - DNA, 36 bp, Capnocytophaga canimorsus; identical to SEQ ID NO: 458

SEQ ID NO: 621 - DNA, 51 bp, Capnocytophaga canimorsus
tatttctagaggatcgttggaactgctctcattttggagggtaatcacaac

SEQ ID NO: 622 - DNA, 15 bp, Capnocytophaga canimorsus
tatttctagaggatc

SEQ ID NO: 623 - DNA, 36 bp, Capnocytophaga canimorsus; identical to SEQ ID NO: 458

SEQ ID NO: 624 - DNA, 50 bp, Capnocytophaga canimorsus
atttctagaggatcgttggaactgctctcattttggagggtaatcacaac

SEQ ID NO: 625 - DNA, 14 bp, Capnocytophaga canimorsus
atttctagaggatc

SEQ ID NO: 626 - DNA, 36 bp, Capnocytophaga canimorsus; identical to SEQ ID NO: 458

SEQ ID NO: 627 - DNA, 49 bp, Capnocytophaga canimorsus
tttctagaggatcgttggaactgctctcattttggagggtaatcacaac

SEQ ID NO: 628 - DNA, 13 bp, Capnocytophaga canimorsus
tttctagaggatc

SEQ ID NO: 629 - DNA, 36 bp, Capnocytophaga canimorsus; identical to SEQ ID NO: 458

SEQ ID NO: 630 - DNA, 48 bp, Capnocytophaga canimorsus
ttctagaggatcgttggaactgctctcattttggagggtaatcacaac

SEQ ID NO: 631 - DNA, 12 bp, Capnocytophaga canimorsus
ttctagaggatc

SEQ ID NO: 632 - DNA, 36 bp, Capnocytophaga canimorsus; identical to SEQ ID NO: 458

SEQ ID NO: 633 - DNA, 70 bp, Prevotella species
tgttctaccaagtaatccatatttctagaggatcgttgtagaagcttatcgtttggataggtatgacaac

SEQ ID NO: 634 - DNA, 34 bp, Prevotella species; identical to SEQ ID NO: 565

SEQ ID NO: 635 - DNA, 36 bp, Prevotella species; identical to SEQ ID NO: 441

SEQ ID NO: 636 - DNA, 69 bp, Prevotella species
gttctaccaagtaatccatatttctagaggatcgttgtagaagcttatcgtttggataggtatgacaac

SEQ ID NO: 637 - DNA, 33 bp, Prevotella species; identical to SEQ ID NO: 568

SEQ ID NO: 638 - DNA, 36 bp, Prevotella species; identical to SEQ ID NO: 441

SEQ ID NO: 639 - DNA, 68 bp, Prevotella species
ttctaccaagtaatccatatttctagaggatcgttgtagaagcttatcgtttggataggtatgacaac

SEQ ID NO: 640 - DNA, 32 bp, Prevotella species; identical to SEQ ID NO: 571

SEQ ID NO: 641 - DNA, 36 bp, Prevotella species; identical to SEQ ID NO: 441

SEQ ID NO: 642 - DNA, 67 bp, Prevotella species
tctaccaagtaatccatatttctagaggatcgttgtagaagcttatcgtttggataggtatgacaac

SEQ ID NO: 643 - DNA, 31 bp, Prevotella species; identical to SEQ ID NO: 574

SEQ ID NO: 644 - DNA, 36 bp, Prevotella species; identical to SEQ ID NO: 441

SEQ ID NO: 645 - DNA, 66 bp, Prevotella species; identical to SEQ ID NO: 468

SEQ ID NO: 646 - DNA, 30 bp, Prevotella species; identical to SEQ ID NO: 454

SEQ ID NO: 647 - DNA, 36 bp, Prevotella species; identical to SEQ ID NO: 441

SEQ ID NO: 648 - DNA, 65 bp, Prevotella species
taccaagtaatccatatttctagaggatcgttgtagaagcttatcgtttggataggtatgacaac

SEQ ID NO: 649 - DNA, 29 bp, Prevotella species
taccaagtaatccatatttctagaggatc

SEQ ID NO: 650 - DNA, 36 bp, Prevotella species; identical to SEQ ID NO: 441

SEQ ID NO: 651 - DNA, 64 bp, Prevotella species
accaagtaatccatatttctagaggatcgttgtagaagcttatcgtttggataggtatgacaac

SEQ ID NO: 652 - DNA, 28 bp, Prevotella species
accaagtaatccatatttctagaggatc

SEQ ID NO: 653 - DNA, 36 bp, Prevotella species; identical to SEQ ID NO: 441

SEQ ID NO: 654 - DNA, 63 bp, Prevotella species
ccaagtaatccatatttctagaggatcgttgtagaagcttatcgtttggataggtatgacaac

SEQ ID NO: 655 - DNA, 27 bp, Prevotella species
ccaagtaatccatatttctagaggatc

SEQ ID NO: 656 - DNA, 36 bp, Prevotella species; identical to SEQ ID NO: 441

SEQ ID NO: 657 - DNA, 62 bp, Prevotella species
caagtaatccatatttctagaggatcgttgtagaagcttatcgtttggataggtatgacaac

SEQ ID NO: 658 - DNA, 26 bp, Prevotella species
caagtaatccatatttctagaggatc

SEQ ID NO: 659 - DNA, 36 bp, Prevotella species; identical to SEQ ID NO: 441

SEQ ID NO: 660 - DNA, 61 bp, Prevotella species
aagtaatccatatttctagaggatcgttgtagaagcttatcgtttggataggtatgacaac

SEQ ID NO: 661 - DNA, 25 bp, Prevotella species
aagtaatccatatttctagaggatc

SEQ ID NO: 662 - DNA, 36 bp, Prevotella species; identical to SEQ ID NO: 441

SEQ ID NO: 663 - DNA, 60 bp, Prevotella species
agtaatccatatttctagaggatcgttgtagaagcttatcgtttggataggtatgacaac

SEQ ID NO: 664 - DNA, 24 bp, Prevotella species
agtaatccatatttctagaggatc

SEQ ID NO: 665 - DNA, 36 bp, Prevotella species; identical to SEQ ID NO: 441

SEQ ID NO: 666 - DNA, 59 bp, Prevotella species
gtaatccatatttctagaggatcgttgtagaagcttatcgtttggataggtatgacaac

SEQ ID NO: 667 - DNA, 23 bp, Prevotella species
gtaatccatatttctagaggatc

SEQ ID NO: 668 - DNA, 36 bp, Prevotella species; identical to SEQ ID NO: 441

SEQ ID NO: 669 - DNA, 58 bp, Prevotella species
taatccatatttctagaggatcgttgtagaagcttatcgtttggataggtatgacaac

SEQ ID NO: 670 - DNA, 21 bp, Prevotella species
taatccatatttctagaggat

SEQ ID NO: 671 - DNA, 36 bp, Prevotella species; identical to SEQ ID NO: 441

SEQ ID NO: 672 - DNA, 57 bp, Prevotella species
aatccatatttctagaggatcgttgtagaagcttatcgtttggataggtatgacaac

SEQ ID NO: 673 - DNA, 21 bp, Prevotella species
aatccatatttctagaggatc

SEQ ID NO: 674 - DNA, 36 bp, Prevotella species; identical to SEQ ID NO: 441

SEQ ID NO: 675 - DNA, 56 bp, Prevotella species
atccatatttctagaggatcgttgtagaagcttatcgtttggataggtatgacaac

SEQ ID NO: 676 - DNA, 20 bp, Prevotella species
atccatatttctagaggatc

SEQ ID NO: 677 - DNA, 36 bp, Prevotella species; identical to SEQ ID NO: 441

SEQ ID NO: 678 - DNA, 55 bp, Prevotella species
tccatatttctagaggatcgttgtagaagcttatcgtttggataggtatgacaac

SEQ ID NO: 679 - DNA, 19 bp, Prevotella species
tccatatttctagaggatc

SEQ ID NO: 680 - DNA, 36 bp, Prevotella species; identical to SEQ ID NO: 441

SEQ ID NO: 681 - DNA, 54 bp, Prevotella species
ccatatttctagaggatcgttgtagaagcttatcgtttggataggtatgacaac

SEQ ID NO: 682 - DNA, 18 bp, Prevotella species
ccatatttctagaggatc

SEQ ID NO: 683 - DNA, 36 bp, Prevotella species; identical to SEQ ID NO: 441

SEQ ID NO: 684 - DNA, 53 bp, Prevotella species
catatttctagaggatcgttgtagaagcttatcgtttggataggtatgacaac

SEQ ID NO: 685 - DNA, 17 bp, Prevotella species
catatttctagaggatc

SEQ ID NO: 686 - DNA, 36 bp, Prevotella species; identical to SEQ ID NO: 441

SEQ ID NO: 687 - DNA, 52 bp, Prevotella species
atatttctagaggatcgttgtagaagcttatcgtttggataggtatgacaac

SEQ ID NO: 688 - DNA, 16 bp, Prevotella species
atatttctagaggatc

SEQ ID NO: 689 - DNA, 36 bp, Prevotella species; identical to SEQ ID NO: 441

SEQ ID NO: 690 - DNA, 51 bp, Prevotella species
tatttctagaggatcgttgtagaagcttatcgtttggataggtatgacaac

SEQ ID NO: 691 - DNA, 15 bp, Prevotella species
tatttctagaggatc

SEQ ID NO: 692 - DNA, 36 bp, Prevotella species; identical to SEQ ID NO: 441

SEQ ID NO: 693 - DNA, 50 bp, Prevotella species
atttctagaggatcgttgtagaagcttatcgtttggataggtatgacaac

SEQ ID NO: 694 - DNA, 14 bp, Prevotella species
atttctagaggatc

SEQ ID NO: 695 - DNA, 36 bp, Prevotella species; identical to SEQ ID NO: 441

SEQ ID NO: 696 - DNA, 49 bp, Prevotella species
tttctagaggatcgttgtagaagcttatcgtttggataggtatgacaac

SEQ ID NO: 697 - DNA, 13 bp, Prevotella species
tttctagaggatc

SEQ ID NO: 698 - DNA, 36 bp, Prevotella species; identical to SEQ ID NO: 441

SEQ ID NO: 699 - DNA, 48 bp, Prevotella species
ttctagaggatcgttgtagaagcttatcgtttggataggtatgacaac

SEQ ID NO: 700 - DNA, 12 bp, Prevotella species
ttctagaggatc

SEQ ID NO: 701 - DNA, 36 bp, Prevotella species; identical to SEQ ID NO: 441

SEQ ID NO: 702 - DNA, 64 bp, Leptotrichia wadei
gatttagactaccccaaaaacgaaggggactaaaacccgggtaccgagctcgaattcactggcc

SEQ ID NO: 703 - DNA, 28 bp, Leptotrichia wadei
ccgggtaccgagctcgaattcactggcc

SEQ ID NO: 704 - DNA, 36 bp, Leptotrichia wadei; identical to SEQ ID NO: 435

SEQ ID NO: 705 - DNA, 64 bp, Leptotrichia wadei
gatttagactaccccaaaaacgaaggggactaaaactttctagaggatccccgggtaccgagct

SEQ ID NO: 706 - DNA, 28 bp, Leptotrichia wadei
tttctagaggatccccgggtaccgagct

SEQ ID NO: 707 - DNA, 36 bp, Leptotrichia wadei; identical to SEQ ID NO: 435

SEQ ID NO: 708 - DNA, 64 bp, Leptotrichia wadei
gatttagactaccccaaaaacgaaggggactaaaacccaagtaatccatatttctagaggatcc

SEQ ID NO: 709 - DNA, 28 bp, Leptotrichia wadei
ccaagtaatccatatttctagaggatcc

SEQ ID NO: 710 - DNA, 36 bp, Leptotrichia wadei; identical to SEQ ID NO: 435

SEQ ID NO: 711 - DNA, 64 bp, Leptotrichia wadei
gatttagactaccccaaaaacgaaggggactaaaacagattgctgttctaccaagtaatccata

SEQ ID NO: 712 - DNA, 28 bp, Leptotrichia wadei
agattgctgttctaccaagtaatccata

SEQ ID NO: 713 - DNA, 36 bp, Leptotrichia wadei; identical to SEQ ID NO: 435

SEQ ID NO: 714 - DNA, 64 bp, Leptotrichia wadei
gatttagactaccccaaaaacgaaggggactaaaaccctgcaggtcgagtagattgctgttcta

SEQ ID NO: 715 - DNA, 28 bp, Leptotrichia wadei
cctgcaggtcgagtagattgctgttcta

SEQ ID NO: 716 - DNA, 36 bp, Leptotrichia wadei; identical to SEQ ID NO: 435

SEQ ID NO: 717 - DNA, 64 bp, Leptotrichia wadei
gatttagactaccccaaaaacgaaggggactaaaacgccaagcttgcatgcctgcaggtcgagt

SEQ ID NO: 718 - DNA, 28 bp, Leptotrichia wadei
gccaagcttgcatgcctgcaggtcgagt

SEQ ID NO: 719 - DNA, 36 bp, Leptotrichia wadei; identical to SEQ ID NO: 435

SEQ ID NO: 720 - DNA, 64 bp, Leptotrichia wadei
gatttagactaccccaaaaacgaaggggactaaaacatgaccatgattacgccaagcttgcatg

SEQ ID NO: 721 - DNA, 28 bp, Leptotrichia wadei
atgaccatgattacgccaagcttgcatg

SEQ ID NO: 722 - DNA, 36 bp, Leptotrichia wadei; identical to SEQ ID NO: 435

SEQ ID NO: 723 - DNA, 64 bp, Leptotrichia wadei
gatttagactaccccaaaaacgaaggggactaaaaccacaggaaacagctatgaccatgattac

SEQ ID NO: 724 - DNA, 28 bp, Leptotrichia wadei
cacaggaaacagctatgaccatgattac

SEQ ID NO: 725 - DNA, 36 bp, Leptotrichia wadei; identical to SEQ ID NO: 435

SEQ ID NO: 726 - DNA, 64 bp, Leptotrichia wadei
gatttagactaccccaaaaacgaaggggactaaaactgtgagcggataaacacaggaaacagct

SEQ ID NO: 727 - DNA, 28 bp, Leptotrichia wadei
tgtgagcggataaacacaggaaacagct

SEQ ID NO: 728 - DNA, 36 bp, Leptotrichia wadei; identical to SEQ ID NO: 435

SEQ ID NO: 729 - DNA, 64 bp, Leptotrichia wadei
gatttagactaccccaaaaacgaaggggactaaaacatgttgtgtggaattgtgagcggataaa

SEQ ID NO: 730 - DNA, 28 bp, Leptotrichia wadei
atgttgtgtggaattgtgagcggataaa

SEQ ID NO: 731 - DNA, 36 bp, Leptotrichia wadei; identical to SEQ ID NO: 435

SEQ ID NO: 732 - DNA, 64 bp, Leptotrichia wadei
gatttagactaccccaaaaacgaaggggactaaaactgcttccggctcgtatgttgtgtggaat

SEQ ID NO: 733 - DNA, 28 bp, Leptotrichia wadei
tgcttccggctcgtatgttgtgtggaat

SEQ ID NO: 734 - DNA, 36 bp, Leptotrichia wadei; identical to SEQ ID NO: 435

SEQ ID NO: 735 - DNA, 66 bp, Capnocytophaga canimorsus
ccccgggtaccgagctcgaattcactggccgttggaactgctctcattttggagggtaatcacaac

SEQ ID NO: 736 - DNA, 30 bp, Capnocytophaga canimorsus
ccccgggtaccgagctcgaattcactggcc

SEQ ID NO: 737 - DNA, 36 bp, Capnocytophaga canimorsus; identical to SEQ ID NO: 458

SEQ ID NO: 738 - DNA, 66 bp, Capnocytophaga canimorsus
tatttctagaggatccccgggtaccgagctgttggaactgctctcattttggagggtaatcacaac

SEQ ID NO: 739 - DNA, 30 bp, Capnocytophaga canimorsus
tatttctagaggatccccgggtaccgagct

SEQ ID NO: 740 - DNA, 36 bp, Capnocytophaga canimorsus; identical to SEQ ID NO: 458

SEQ ID NO: 741 - DNA, 66 bp, Capnocytophaga canimorsus
taccaagtaatccatatttctagaggatccgttggaactgctctcattttggagggtaatcacaac

SEQ ID NO: 742 - DNA, 30 bp, Capnocytophaga canimorsus
taccaagtaatccatatttctagaggatcc

SEQ ID NO: 743 - DNA, 36 bp, Capnocytophaga canimorsus; identical to SEQ ID NO: 458

SEQ ID NO: 744 - DNA, 66 bp, Capnocytophaga canimorsus
gtagattgctgttctaccaagtaatccatagttggaactgctctcattttggagggtaatcacaac

SEQ ID NO: 745 - DNA, 30 bp, Capnocytophaga canimorsus
gtagattgctgttctaccaagtaatccata

SEQ ID NO: 746 - DNA, 36 bp, Capnocytophaga canimorsus; identical to SEQ ID NO: 458

SEQ ID NO: 747 - DNA, 66 bp, Capnocytophaga canimorsus
tgcctgcaggtcgagtagattgctgttctagttggaactgctctcattttggagggtaatcacaac

SEQ ID NO: 748 - DNA, 30 bp, Capnocytophaga canimorsus
tgcctgcaggtcgagtagattgctgttcta

SEQ ID NO: 749 - DNA, 36 bp, Capnocytophaga canimorsus; identical to SEQ ID NO: 458

SEQ ID NO: 750 - DNA, 66 bp, Capnocytophaga canimorsus
acgccaagcttgcatgcctgcaggtcgagtgttggaactgctctcattttggagggtaatcacaac

SEQ ID NO: 751 - DNA, 30 bp, Capnocytophaga canimorsus
acgccaagcttgcatgcctgcaggtcgagt

SEQ ID NO: 752 - DNA, 36 bp, Capnocytophaga canimorsus; identical to SEQ ID NO: 458

SEQ ID NO: 753 - DNA, 66 bp, Capnocytophaga canimorsus
ctatgaccatgattacgccaagcttgcatggttggaactgctctcattttggagggtaatcacaac

SEQ ID NO: 754 - DNA, 30 bp, Capnocytophaga canimorsus
ctatgaccatgattacgccaagcttgcatg

SEQ ID NO: 755 - DNA, 36 bp, Capnocytophaga canimorsus; identical to SEQ ID NO: 458

SEQ ID NO: 756 - DNA, 66 bp, Capnocytophaga canimorsus
aacacaggaaacagctatgaccatgattacgttggaactgctctcattttggagggtaatcacaac

SEQ ID NO: 757 - DNA, 30 bp, Capnocytophaga canimorsus
aacacaggaaacagctatgaccatgattac

SEQ ID NO: 758 - DNA, 36 bp, Capnocytophaga canimorsus; identical to SEQ ID NO: 458

SEQ ID NO: 759 - DNA, 66 bp, Capnocytophaga canimorsus
attgtgagcggataaacacaggaaacagctgttggaactgctctcattttggagggtaatcacaac

SEQ ID NO: 760 - DNA, 30 bp, Capnocytophaga canimorsus
attgtgagcggataaacacaggaaacagct

SEQ ID NO: 761 - DNA, 36 bp, Capnocytophaga canimorsus; identical to SEQ ID NO: 458

SEQ ID NO: 762 - DNA, 66 bp, Capnocytophaga canimorsus
gtatgttgtgtggaattgtgagcggataaagttggaactgctctcattttggagggtaatcacaac

SEQ ID NO: 763 - DNA, 30 bp, Capnocytophaga canimorsus
gtatgttgtgtggaattgtgagcggataaa

SEQ ID NO: 764 - DNA, 36 bp, Capnocytophaga canimorsus; identical to SEQ ID NO: 458

SEQ ID NO: 765 - DNA, 66 bp, Capnocytophaga canimorsus
tatgcttccggctcgtatgttgtgtggaatgttggaactgctctcattttggagggtaatcacaac

SEQ ID NO: 766 - DNA, 30 bp, Capnocytophaga canimorsus
tatgcttccggctcgtatgttgtgtggaat

SEQ ID NO: 767 - DNA, 36 bp, Capnocytophaga canimorsus; identical to SEQ ID NO: 458

SEQ ID NO: 768 - DNA, 66 bp, Prevotella species
ccccgggtaccgagctcgaattcactggccgttgtagaagcttatcgtttggataggtatgacaac

SEQ ID NO: 769 - DNA, 30 bp, Prevotella species; identical to SEQ ID NO: 736

SEQ ID NO: 770 - DNA, 36 bp, Prevotella species; identical to SEQ ID NO: 441

SEQ ID NO: 771 - DNA, 66 bp, Prevotella species
tatttctagaggatccccgggtaccgagctgttgtagaagcttatcgtttggataggtatgacaac

SEQ ID NO: 772 - DNA, 30 bp, Prevotella species; identical to SEQ ID NO: 739

SEQ ID NO: 773 - DNA, 36 bp, Prevotella species; identical to SEQ ID NO: 441

SEQ ID NO: 774 - DNA, 66 bp, Prevotella species
taccaagtaatccatatttctagaggatccgttgtagaagcttatcgtttggataggtatgacaac

SEQ ID NO: 775 - DNA, 30 bp, Prevotella species; identical to SEQ ID NO: 742

SEQ ID NO: 776 - DNA, 36 bp, Prevotella species; identical to SEQ ID NO: 441

SEQ ID NO: 777 - DNA, 66 bp, Prevotella species
gtagattgctgttctaccaagtaatccatagttgtagaagcttatcgtttggataggtatgacaac

SEQ ID NO: 778 - DNA, 30 bp, Prevotella species; identical to SEQ ID NO: 745

SEQ ID NO: 779 - DNA, 36 bp, Prevotella species; identical to SEQ ID NO: 441

SEQ ID NO: 780 - DNA, 66 bp, Prevotella species
tgcctgcaggtcgagtagattgctgttctagttgtagaagcttatcgtttggataggtatgacaac

SEQ ID NO: 781 - DNA, 30 bp, Prevotella species; identical to SEQ ID NO: 748

SEQ ID NO: 782 - DNA, 36 bp, Prevotella species; identical to SEQ ID NO: 441

SEQ ID NO: 783 - DNA, 66 bp, Prevotella species
acgccaagcttgcatgcctgcaggtcgagtgttgtagaagcttatcgtttggataggtatgacaac

SEQ ID NO: 784 - DNA, 30 bp, Prevotella species; identical to SEQ ID NO: 751

SEQ ID NO: 785 - DNA, 36 bp, Prevotella species; identical to SEQ ID NO: 441

SEQ ID NO: 786 - DNA, 66 bp, Prevotella species
ctatgaccatgattacgccaagcttgcatggttgtagaagcttatcgtttggataggtatgacaac

SEQ ID NO: 787 - DNA, 30 bp, Prevotella species; identical to SEQ ID NO: 754

SEQ ID NO: 788 - DNA, 36 bp, Prevotella species; identical to SEQ ID NO: 441

SEQ ID NO: 789 - DNA, 66 bp, Prevotella species
aacacaggaaacagctatgaccatgattacgttgtagaagcttatcgtttggataggtatgacaac

SEQ ID NO: 790 - DNA, 30 bp, Prevotella species; identical to SEQ ID NO: 757

SEQ ID NO: 791 - DNA, 36 bp, Prevotella species; identical to SEQ ID NO: 441

SEQ ID NO: 792 - DNA, 66 bp, Prevotella species
attgtgagcggataaacacaggaaacagctgttgtagaagcttatcgtttggataggtatgacaac

SEQ ID NO: 793 - DNA, 30 bp, Prevotella species; identical to SEQ ID NO: 760

SEQ ID NO: 794 - DNA, 36 bp, Prevotella species; identical to SEQ ID NO: 441

SEQ ID NO: 795 - DNA, 66 bp, Prevotella species
gtatgttgtgtggaattgtgagcggataaagttgtagaagcttatcgtttggataggtatgacaac

SEQ ID NO: 796 - DNA, 30 bp, Prevotella species; identical to SEQ ID NO: 763

SEQ ID NO: 797 - DNA, 36 bp, Prevotella species; identical to SEQ ID NO: 441

SEQ ID NO: 798 - DNA, 66 bp, Prevotella species
tatgcttccggctcgtatgttgtgtggaatgttgtagaagcttatcgtttggataggtatgacaac

SEQ ID NO: 799 - DNA, 30 bp, Prevotella species; identical to SEQ ID NO: 766

SEQ ID NO: 800 - DNA, 36 bp, Prevotella species; identical to SEQ ID NO: 441

SEQ ID NO: 801 - DNA, 66 bp, Zika virus
cttgaactctaccagtgcttctttgttgttgttggaactgctctcattttggagggtaatcacaac

SEQ ID NO: 802 - DNA, 30 bp, Zika virus
cttgaactctaccagtgcttctttgttgtt

SEQ ID NO: 803 - DNA, 36 bp, Zika virus; identical to SEQ ID NO: 458

SEQ ID NO: 804 - DNA, 66 bp, Dengue virus
tttgcttctgtccagtgagcatggtcttcggttggaactgctctcattttggagggtaatcacaac

SEQ ID NO: 805 - DNA, 30 bp, Dengue virus; identical to SEQ ID NO: 502

SEQ ID NO: 806 - DNA, 36 bp, Dengue virus; identical to SEQ ID NO: 458

SEQ ID NO: 807 - DNA, 65 bp, Homo sapiens
ccgcttcaccggctacccctgctccaagagttgtagaagcttatcgtttggataggtatgacaac

SEQ ID NO: 808 - DNA, 29 bp, Homo sapiens
ccgcttcaccggctacccctgctccaaga

SEQ ID NO: 809 - DNA, 36 bp, Homo sapiens; identical to SEQ ID NO: 441

SEQ ID NO: 810 - DNA, 64 bp, Homo sapiens
gatttagactaccccaaaaacgaaggggactaaaacctgcaccttctaccaccacctccgccag

SEQ ID NO: 811 - DNA, 28 bp, Homo sapiens
ctgcaccttctaccaccacctccgccag

SEQ ID NO: 812 - DNA, 36 bp, Homo sapiens; identical to SEQ ID NO: 435

SEQ ID NO: 813 - DNA, 64 bp, Artificial Sequence
  Synthetic Oligonucleotide
gatttagactaccccaaaaacgaaggggactaaaactagattgctgttctaccaagtaatccat

SEQ ID NO: 814 - DNA, 28 bp, Artificial Sequence
  Synthetic Oligonucleotide
tagattgctgttctaccaagtaatccat

SEQ ID NO: 815 - DNA, 36 bp, Artificial Sequence; identical to SEQ ID NO: 435
  Synthetic Oligonucleotide

SEQ ID NO: 816 - DNA, 64 bp, Homo sapiens
gatttagactaccccaaaaacgaaggggactaaaacgcaagatgagctgcacggtggaggtgag

SEQ ID NO: 817 - DNA, 28 bp, Homo sapiens
gcaagatgagctgcacggtggaggtgag

SEQ ID NO: 818 - DNA, 36 bp, Homo sapiens; identical to SEQ ID NO: 435

SEQ ID NO: 819 - DNA, 64 bp, Homo sapiens
gatttagactaccccaaaaacgaaggggactaaaacgcgtcatgagctgcacggtggaggtgag

SEQ ID NO: 820 - DNA, 28 bp, Homo sapiens
gcgtcatgagctgcacggtggaggtgag

SEQ ID NO: 821 - DNA, 36 bp, Homo sapiens; identical to SEQ ID NO: 435

SEQ ID NO: 822 - DNA, 66 bp, Prevotella species
tagattgctgttctaccaagtaatccatatgttgtagaagcttatcgtttggataggtatgacaac

SEQ ID NO: 823 - DNA, 30 bp, Prevotella species
tagattgctgttctaccaagtaatccatat

SEQ ID NO: 824 - DNA, 36 bp, Prevotella species; identical to SEQ ID NO: 441

SEQ ID NO: 825 - DNA, 64 bp, Leptotrichia wadei
gatttagactaccccaaaaacgaaggggactaaaacgattgctgttctaccaagtaatccatat

SEQ ID NO: 826 - DNA, 28 bp, Leptotrichia wadei
gattgctgttctaccaagtaatccatat

SEQ ID NO: 827 - DNA, 36 bp, Leptotrichia wadei; identical to SEQ ID NO: 435

SEQ ID NO: 828 - RNA, 170 nt, Dengue virus
aguacauauucaggggccaaccucucaacaaugacgaagaccaugcucacuggacagaagcaaaaaugcugcuggacaacaucaacacaccagaagggauuauaccagcucucuuugaaccagaaagggagaagucagccgccauagacggugaauaccgccugaagggu

SEQ ID NO: 829 - DNA, 173 bp, Artificial Sequence; identical to SEQ ID NO: 206
  Synthetic Oligonucleotide

SEQ ID NO: 830 - RNA, 174 nt, Zika virus
gacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggc

SEQ ID NO: 831 - DNA, 190 bp, Artificial Sequence
  Synthetic Oligonucleotide
ttaattaaagcgattgatggtgatactgttaaattaatgtacaaaggtcaaccaatgacattcagactattattggttgatacacctgaaacaaagcatcctaaaaaaggtgtagagaaatatggtcctgaagcaagtgcatttacgaaaaagatggtagaaaatgcaaagaaaattgaagtcgagtttg

SEQ ID NO: 832 - DNA, 190 bp, Artificial Sequence
  Synthetic Oligonucleotide
ggggaggatgtcgggcgcgcacgttttcccttcgctgagcacgctgcgcgcgtcgcctacgtgaatgcgctgttcgatgcgttggccgaaggcaacccgcgggtgagcgtgctcgacccctccagcgtgctctgcgatggcctggattgtttcgccgaacgtgatggctggtcgctgtacatggataaca

SEQ ID NO: 833 - RNA, 173 nt, Artificial Sequence
  Synthetic Oligonucleotide
ggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacacaacauacgagccggaagcauaaag

SEQ ID NO: 834 - DNA, 66 bp, Artificial Sequence
  Synthetic Oligonucleotide
  misc_feature (29)..(29): n is a, c, g, or t
  misc_feature (31)..(31): n is a, c, g, or t
  misc_feature (33)..(33): n is a, c, g, or t
  misc_feature (35)..(35): n is a, c, g, or t
  misc_feature (37)..(37): n is a, c, g, or t
  misc_feature (39)..(39): n is a, c, g, or t
ttcctgtgaagctaaagaaggagaatgrnrnrnrnrnrntattgatagcagctgtggcacctgcac

SEQ ID NO: 835 - DNA, 182 bp, Artificial Sequence
  Synthetic Oligonucleotide
tgccagttaacgtcttccttctctctctgtcatagggactctggatcccagaaggtgagaaagttaaaattcccgtcgctatcaagacatctccgaaagccaacaaggaaatcctcgatgtgagtttctgctttgctgtgtgggggtccatggctctgaacctcaggcccaccttttctcat

SEQ ID NO: 836 - DNA, 197 bp, Artificial Sequence
  Synthetic Oligonucleotide
tgccagttaacgtcttccttctctctctgtcatagggactctggatcccagaaggtgagaaagttaaaattcccgtcgctatcaaggaattaagagaagcaacatctccgaaagccaacaaggaaatcctcgatgtgagtttctgctttgctgtgtgggggtccatggctctgaacctcaggcccaccttttctcat

SEQ ID NO: 837 - DNA, 194 bp, Artificial Sequence
  Synthetic Oligonucleotide
cctccctccaggaagcctacgtgatggccagcgtggacaacccccacgtgtgccgcctgctgggcatctgcctcacctccaccgtgcagctcatcatgcagctcatgcccttcggctgcctcctggactatgtccgggaacacaaagacaatattggctcccagtacctgctcaactggtgtgtgcagatcgca

SEQ ID NO: 838 - DNA, 194 bp, Artificial Sequence
  Synthetic Oligonucleotide
cctccctccaggaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgca

SEQ ID NO: 839 - RNA, 171 nt, Leptotrichia wadei
uagguguuccacaggguagccagcagcauccugcgaugcaaauauggauuacuugguagaacagcaaucuaauccggaacauaauggugcagggcgcugacuuccgcguuuguuuuaaaucaaacacggaaaccgaagaccauucauguuguugcugccggaagcauaaag

SEQ ID NO: 840 - RNA, 171 nt, Prevotella species
uagguguuccacaggguagccagcagcauccugcgaugcaaauauggauuacuugguagaacagcaaucuaauccggaacauaauggugcagggcgcugacuuccgcguuugaaaaaaaacaaacacggaaaccgaagaccauucauguuguugcugccggaagcauaaag

SEQ ID NO: 841 - DNA, 25 bp, Artificial Sequence
  Synthetic Oligonucleotide
gtacatattcaggggccaacctctc

SEQ ID NO: 842 - DNA, 50 bp, Artificial Sequence
  Synthetic Oligonucleotide
gaaattaatacgactcactataggggtacatattcaggggccaacctctc

SEQ ID NO: 843 - DNA, 25 bp, Artificial Sequence
  Synthetic Oligonucleotide
tttctggttcaaagagagctggtat

SEQ ID NO: 844 - DNA, 28 bp, Artificial Sequence
  Synthetic Oligonucleotide
tgtacaaaggtcaaccaatgacattcag

SEQ ID NO: 845 - DNA, 53 bp, Artificial Sequence
  Synthetic Oligonucleotide
gaaattaatacgactcactatagggtgtacaaaggtcaaccaatgacattcag

SEQ ID NO: 846 - DNA, 25 bp, Artificial Sequence
  Synthetic Oligonucleotide
tgcacttgcttcaggaccatatttc

SEQ ID NO: 847 - DNA, 23 bp, Artificial Sequence
  Synthetic Oligonucleotide
ctacgtgaatgcgctgttcgatg

SEQ ID NO: 848 - DNA, 48 bp, Artificial Sequence
  Synthetic Oligonucleotide
gaaattaatacgactcactatagggctacgtgaatgcgctgttcgatg

SEQ ID NO: 849 - DNA, 24 bp, Artificial Sequence
  Synthetic Oligonucleotide
gaaacaatccaggccatcgcagag

SEQ ID NO: 850 - DNA, 30 bp, Artificial Sequence
  Synthetic Oligonucleotide
tctggatcccagaaggtgagaaagttaaaa

SEQ ID NO: 851 - DNA, 55 bp, Artificial Sequence
  Synthetic Oligonucleotide
gaaattaatacgactcactatagggtctggatcccagaaggtgagaaagttaaaa

SEQ ID NO: 852 - DNA, 30 bp, Artificial Sequence
  Synthetic Oligonucleotide
ccacacagcaaagcagaaactcacatcgag

SEQ ID NO: 853 - DNA, 30 bp, Artificial Sequence; identical to SEQ ID NO: 850
  Synthetic Oligonucleotide

SEQ ID NO: 854 - DNA, 55 bp, Artificial Sequence; identical to SEQ ID NO: 851
  Synthetic Oligonucleotide

SEQ ID NO: 855 - DNA, 30 bp, Artificial Sequence; identical to SEQ ID NO: 852
  Synthetic Oligonucleotide

SEQ ID NO: 856 - DNA, 32 bp, Artificial Sequence
  Synthetic Oligonucleotide
agggccgccactccaccggcggcatggatgag

SEQ ID NO: 857 - DNA, 57 bp, Artificial Sequence
  Synthetic Oligonucleotide
gaaattaatacgactcactatagggagggccgccactccaccggcggcatggatgag

SEQ ID NO: 858 - DNA, 33 bp, Artificial Sequence
  Synthetic Oligonucleotide
gaagagttcttcacctttactcacggatcctcc

SEQ ID NO: 859 - DNA, 25 bp, Artificial Sequence
  Synthetic Oligonucleotide
ccacactggaacaacaaagaagcac

SEQ ID NO: 860 - DNA, 50 bp, Artificial Sequence
  Synthetic Oligonucleotide
gaaattaatacgactcactatagggccacactggaacaacaaagaagcac

SEQ ID NO: 861 - DNA, 30 bp, Artificial Sequence
  Synthetic Oligonucleotide
acagccttccctttgcaccatccatctcag

SEQ ID NO: 862 - DNA, 32 bp, Artificial Sequence
  Synthetic Oligonucleotide
atagtcccctcggcgaacatggacccctacaa

SEQ ID NO: 863 - DNA, 57 bp, Artificial Sequence; identical to SEQ ID NO: 35
  Synthetic Oligonucleotide

SEQ ID NO: 864 - DNA, 32 bp, Artificial Sequence; identical to SEQ ID NO: 34
  Synthetic Oligonucleotide

SEQ ID NO: 865 - DNA, 34 bp, Artificial Sequence
  Synthetic Oligonucleotide
atcctctagaaatatggattacttggtagaacag

SEQ ID NO: 866 - DNA, 59 bp, Artificial Sequence; identical to SEQ ID NO: 18
  Synthetic Oligonucleotide

SEQ ID NO: 867 - DNA, 35 bp, Artificial Sequence; identical to SEQ ID NO: 19
  Synthetic Oligonucleotide

SEQ ID NO: 868 - DNA, 30 bp, Artificial Sequence
  Synthetic Oligonucleotide
ccccacgtgtgccgcctgctgggcatctgc

SEQ ID NO: 869 - DNA, 55 bp, Artificial Sequence
  Synthetic Oligonucleotide
gaaattaatacgactcactatagggccccacgtgtgccgcctgctgggcatctgc

SEQ ID NO: 870 - DNA, 30 bp, Artificial Sequence
  Synthetic Oligonucleotide
atattgtctttgtgttcccggacatagtcc

SEQ ID NO: 871 - RNA, 14 nt, Artificial Sequence
  Synthetic Oligonucleotide
  misc_feature (1)..(1): 5' FAM tag
  misc_feature (1)..(1): modified nucleotide
  misc_feature (7)..(8): modified nucleotide
  misc_feature (14)..(14): modified nucleotide
  misc_feature (14)..(14): 3' biotin tag
aauggcaaauggca

SEQ ID NO: 872 - DNA, 60 bp, Artificial Sequence
  Synthetic Oligonucleotide
  misc_feature (28)..(33): RNA nucleotide
ttcctgtgaagctaaagaaggagaatgnnnnnntattgatagcagctgtggcacctgcac

SEQ ID NO: 873 - RNA, 46 nt, Artificial Sequence
  Synthetic Oligonucleotide
  misc_feature (1)..(1): 5' thiol modification
  misc_feature (46)..(46): 3' thiol modification
cucccuaauaacaauuuauaacuauuccuacccuuucccaaaaaaa

SEQ ID NO: 874 - DNA, 47 bp, Artificial Sequence
  Synthetic Oligonucleotide
  misc_feature (1)..(1): 5' amino modification
  misc_feature (30)..(31): biotin modification
  misc_feature (47)..(47): 3' FAM tag
agagcatcaccatgatcctguuuuuuuutgctcggatatctcgacta

SEQ ID NO: 875 - RNA, 12 nt, Artificial Sequence
  Synthetic Oligonucleotide
  misc_feature (1)..(1): 5' FAM tag
  misc_feature (12)..(12): 3' biotin tag
aaaaaaaaaaaa

SEQ ID NO: 876 - RNA, 12 nt, Artificial Sequence
  Synthetic Oligonucleotide
  misc_feature (1)..(1): 5' FAM tag
  misc_feature (12)..(12): 3' biotin tag
cccccccccccc

SEQ ID NO: 877 - RNA, 12 nt, Artificial Sequence
  Synthetic Oligonucleotide
  misc_feature (1)..(1): 5' FAM tag
  misc_feature (12)..(12): 3' biotin tag
acacacacacac

SEQ ID NO: 878 - protein, 1175 aa, Porphyromonas gulae; identical to SEQ ID NO: 423

What is claimed is:

1. A lateral flow device comprising a substrate comprising a first end, wherein the first end comprises a sample loading portion and a first region loaded with a detectable ligand, a CRISPR effector system, a detection construct, a first capture region comprising a first binding agent, and a second capture region comprising a second binding agent, wherein the CRISPR effector system comprises a Cas12 or Cas13 effector protein and one or more guide sequences, each guide sequence configured to bind one or more target molecules.

2. The lateral flow device of claim 1, wherein the detection construct comprises an RNA or DNA oligonucleotide, comprising a first molecule on a first end and a second molecule on a second end, optionally wherein the first 8. The lateral flow device of claim 5, wherein the antibody is an anti-FITC antibody or an anti-biotin antibody.

9. The lateral flow device of claim 1, wherein the substrate is a flexible materials substrate, optionally a paper substrate or a flexible polymer based substrate.

10. The lateral flow device of claim 9, wherein the Cas13 effector protein is from an organism of a genus selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter,* and *Lachnospira.*

11. The lateral flow device of claim 10, wherein the Cas13 effector protein is from an organism selected from the group consisting of: *Leptotrichia shahii*; Leptotrichia *wadei* (Lw2); *Listeria seeligeri;* *Lachnospiraceae bacterium* MA2020; *Lachnospiraceae bacterium* NK4A 179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; *Listeriaceae bacterium* FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; [*Eubacterium*] *rectale; Eubacteriaceae bacterium* CHKCI004; *Blautia* sp. Marseille-P2398; and *Leptotrichia* sp. oral taxon 879 str. F0557, Twelve (12) further non-limiting examples are: *Lachnospiraceae bacterium* NK4A 144; *Chloroflexus aggregans; Demequina aurantiaca; Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae; Porphyromonadaceae bacterium* KH3CP3RA; *Listeria riparia;* and *Insolitispirillum peregrinum;* wherein the Cas13 effector protein is optionally a *L. wadei* F0279 or *L. wadei* F0279 (Lw2) C2c2 effector protein.

12. The lateral flow device of claim 9, wherein the Cas12 effector protein is a Cas12a effector protein, a Cas12b effector protein, or a combination thereof, or wherein the Cas13 effector protein is a Cas13b effector protein.

13. The lateral flow device of claim 1, wherein the one or more guide sequences that are diagnostic for a disease state; wherein the disease state is optionally cancer, an autoimmune disease, or an infection.

14. The lateral flow device of claim 13, wherein the infection is caused by a virus, a bacterium, a fungus, a protozoan, or a parasite.

15. The lateral flow device of claim 14, wherein the infection is a viral infection; optionally caused by a DNA virus; optionally wherein the DNA virus is a Myoviridae, Podoviridae, Siphoviridae, Alloherpesviridae, Herpesviridae (including human herpes virus, and Varicella Zorter virus), Malocoherpesviridae, Lipothrixviridae, Rudiviridae, Adenoviridae, Ampullaviridae, Ascoviridae, Asfarviridae (including African swine fever virus), Baculoviridae, Cicaudaviridae, Clavaviridae, Corticoviridae, Fuselloviridae, Globuloviridae, Guttaviridae, Hytrosaviridae, Iridoviridae, Maseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus.

16. The lateral flow device of claim 14, wherein the infection is a viral infection caused by a double-stranded RNA virus, a positive sense RNA virus, a negative sense RNA virus, a retrovirus, or a combination thereof; optionally by a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus; optionally by Coronavirus, SARS-Coronavirus, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus; wherein the viral infection is optionally caused by Dengue fever virus.

17. The lateral flow device of claim 14, wherein the infection is a bacterial infection; optionally wherein the bacterium causing the bacterial infection is *Acinetobacter* species, *Actinobacillus* species, *Actinomycetes* species, an *Actinomyces* species, *Aerococcus* species an *Aeromonas* species, an *Anaplasma* species, an *Alcaligenes* species, a *Bacillus* species, a *Bacteroides* species, a *Bartonella* species, a *Bifidobacterium* species, a *Bordetella* species, a *Borrelia* species, a *Brucella* species, a *Burkholderia* species, a *Campylobacter* species, a *Capnocytophaga* species, a *Chlamydia* species, a *Citrobacter* species, a *Coxiella* species, a *Corynbacterium* species, a *Clostridium* species, an *Eikenella* species, an *Enterobacter* species, an *Escherichia* species, an *Enterococcus* species, an *Ehlichia* species, an *Epidermophyton* species, an *Erysipelothrix* species, a *Eubacterium* species, a *Francisella* species, a *Fusobacterium* species, a *Gardnerella* species, a *Gemella* species, a *Haemophilus* species, a *Helicobacter* species, a *Kingella* species, a *Klebsiella* species, a *Lactobacillus* species, a *Lactococcus* species, a *Listeria* species, a *Leptospira* species, a *Legionella* species, a *Leptospira* species, *Leuconostoc* species, a *Mannheimia* species, a *Microsporum* species, a *Micrococcus* species, a *Moraxella* species, a *Morganell* species, a *Mobiluncus* species, a *Micrococcus* species, *Mycobacterium* species, a *Mycoplasm* species, a *Nocardia* species, a *Neisseria* species, a *Pasteurelaa* species, a *Pediococcus* species, a *Peptostreptococcus* species, a *Pityrosporum* species, a *Plesiomonas* species, a *Prevotella* species, a *Porphyromonas* species, a *Proteus* species, a *Providencia* species, a *Pseudomonas* species, a *Propionibacteriums* species, a *Rhodococcus* species, a *Rickettsia* species, a *Rhodococcus* species, a *Serratia* species, a *Stenotrophomonas* species, a *Salmonella* species, a *Serratia* species, a *Shigella* species, a *Staphylococcus* species, a *Streptococcus* species, a *Spirillum* species, a *Streptobacillus* species, a *Treponema* species, a *Tropheryma* species, a *Trichophyton* species, an *Ureaplasma* species, a *Veillonella* species, a *Vibrio* species, a *Yersinia* species, a *Xanthomonas* species, or combination thereof.

18. The lateral flow device of claim 14, wherein the infection is caused by a fungus; wherein the fungus is optionally *Aspergillus, Blastomyces, Candidiasis, Coccidiodomycosis, Cryptococcus neoformans, Cryptococcus gatti,* sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucroymcosis, Sporothrix,* fungal eye infections ringworm, *Exserohilum, Cladosporium, Geotrichum, Saccharomyces,* a *Hansenula* species, a *Candida* species, a *Kluyveromyces* species, a *Debaryomyces* species, a *Pichia* species, a *Penicillium* species, a *Cladosporium* species, a *Byssochlamys* species or a combination thereof.

19. The lateral flow device of claim 14, wherein the infection is caused by a protozoan; wherein the protozoan is optionally *Euglenozoa,* a *Heterolobosea,* a *Diplomonadida,* an *Amoebozoa,* a *Blastocystic,* an *Apicomplexa,* or combination thereof.

20. The lateral flow device of claim 14, wherein the infection is caused by a parasite; wherein the parasite is optionally *Trypanosoma cruzi* (Chagas disease), *T. brucei gambiense, T. brucei rhodesiense, Leishmania braziliensis, L. infantum, L. mexicana, L. major, L. tropica, L. donovani, Naegleria fowleri, Giardia intestinalis* (*G. lamblia, G. duodenalis*), *Canthamoeba castellanii, Balamuthia madrillaris, Entamoeba histolytica, Blastocystic hominis, Babesia microti, Cryptosporidium parvum, Cyclospora cayetanen-*

*sis, Plasmodium falciparum, P. vivax, P. ovale, P. malariae,* and *Toxoplasma gondii*, or a combination thereof.

21. The lateral flow device of claim 1, wherein the sample is a biological sample or an environmental sample; wherein the biological sample is optionally a blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface.

22. The lateral flow device of claim 21, wherein the environmental sample is obtained from a food sample, paper surface, a fabric, a metal surface, a wood surface, a plastic surface, a soil sample, a fresh water sample, a waste water sample, a saline water sample, or a combination thereof.

23. The lateral flow device of claim 13, wherein the disease state is an infection, an organ disease, a blood disease, an immune system disease, a cancer, a brain and nervous system disease, an endocrine disease, a pregnancy or childbirth-related disease, an inherited disease, or an environmentally-acquired disease.

24. The lateral flow device of claim 13, wherein said disease state is characterized by the presence or absence of an antibiotic or drug resistance or susceptibility gene or transcript or polypeptide, preferably in a pathogen or a cell; wherein the one or more guide molecules identify a biological material; wherein the biological material is optionally a genetically modified material; wherein the genetically modified material is optionally a genetically modified plant.

25. A lateral flow device comprising a substrate comprising a first end, wherein the first end comprises a sample loading portion and a first region loaded with a detectable ligand, two or more CRISPR effector systems, two or more detection constructs, one or more first capture regions, each comprising a first binding agent, two or more second capture regions, each comprising a second binding agent, wherein each of the two or more CRISPR effector systems comprises a Cas12 or Cas13 effector protein and one or more guide sequences, each guide sequence configured to bind one or more target molecules.

26. The lateral flow device of claim 25, wherein each of the two or more detection construct comprises an RNA or DNA oligonucleotide, comprising a first molecule on a first end and a second molecule on a second end; wherein the detectable signal optionally appears at the first capture region or the second capture region.

27. The lateral flow device of claim 26, comprising two CRISPR effector systems and two detection constructs; optionally four CRISPR effector systems and four detection constructs; wherein a first detection construct comprises FAM as a first molecule and biotin as a second molecule or vice versa and a second detection construct comprises FAM as a first molecule and Digoxigenin (DIG) as a second molecule or vice versa; wherein the Cas13 effector protein is optionally a C2c2 effector protein.

28. The lateral flow device of claim 25, wherein the sample loading portion further comprises one or more amplification reagents to amplify the one or more target molecules.

29. The lateral flow device of claim 27, wherein a first detection construct comprises Tye665 as a first molecule and Alexa-fluor-488 as a second molecule or vice versa; wherein a second detection construct comprises Tye665 as a first molecule and FAM as a second molecule or vice versa; wherein a third detection construct comprises Tye665 as a first molecule and biotin as a second molecule or vice versa; and wherein a fourth detection construct comprises Tye665 as a first molecule and DIG as a second molecule or vice versa.

30. The lateral flow device of claim 29, wherein the Cas13 effector protein is a Cas13a effector protein or a Cas13b effector protein and the Cas12 effector protein is a Cas12a effector protein or a Cas12b effector protein.

31. A method for detecting a target nucleic acid in a sample, comprising contacting a sample with the first end of the lateral flow device according to claim 1, comprising the sample loading portion; wherein the sample flows from the sample loading portion of the substrate towards the first and second capture regions and generates a detectable signal.

32. The method of claim 31, wherein the sample is a liquid sample, or wherein the sample has been dissolved in an aqueous solvent.

33. The method of claim 31, wherein the sample does not contain target nucleic acid.

34. The method of claim 31, wherein the sample contains target nucleic acid.

35. The method of claim 34, wherein the presence of target nucleic acid is indicative of a disease state.

* * * * *